US011661462B2

(12) United States Patent
Rattel et al.

(10) Patent No.: US 11,661,462 B2
(45) Date of Patent: May 30, 2023

(54) OPTIMIZED CROSS-SPECIES SPECIFIC BISPECIFIC SINGLE CHAIN ANTIBODY CONTRUCTS

(71) Applicant: AMGEN RESEARCH (MUNICH) GMBH, Munich (DE)

(72) Inventors: Benno Rattel, Munich (DE); Matthias Friedrich, Munich (DE); Peter Kufer, Munich (DE); Patrick Hoffmann, Munich (DE); Tobias Raum, Munich (DE); Markus Münz, Munich (DE); Ines Herrmann, Munich (DE); Ralf Lutterbüse, Munich (DE); Elisabeth Nahrwold, Munich (DE)

(73) Assignee: AMGEN RESEARCH (MUNICH) GMBH, Munich (DE)

( * ) Notice: Subject to any disclaimer, the term of this patent is extended or adjusted under 35 U.S.C. 154(b) by 592 days.

(21) Appl. No.: 15/329,672

(22) PCT Filed: Jul. 31, 2015

(86) PCT No.: PCT/IB2015/055815
§ 371 (c)(1),
(2) Date: Jun. 30, 2017

(87) PCT Pub. No.: WO2016/016859
PCT Pub. Date: Feb. 4, 2016

(65) Prior Publication Data
US 2017/0349668 A1    Dec. 7, 2017

Related U.S. Application Data

(60) Provisional application No. 62/031,784, filed on Jul. 31, 2014.

(51) Int. Cl.
*C07K 16/46* (2006.01)
*C07K 16/28* (2006.01)
*C07K 14/765* (2006.01)
*A61K 39/00* (2006.01)

(52) U.S. Cl.
CPC .......... *C07K 16/468* (2013.01); *C07K 14/765* (2013.01); *C07K 16/2803* (2013.01); *C07K 16/2809* (2013.01); *A61K 2039/505* (2013.01); *C07K 2317/14* (2013.01); *C07K 2317/31* (2013.01); *C07K 2317/33* (2013.01); *C07K 2317/34* (2013.01); *C07K 2317/622* (2013.01); *C07K 2317/73* (2013.01); *C07K 2317/94* (2013.01); *C07K 2319/31* (2013.01)

(58) Field of Classification Search
None
See application file for complete search history.

(56) References Cited

U.S. PATENT DOCUMENTS

| | | |
|---|---|---|
| 3,691,016 A | 9/1972 | Patel et al. |
| 3,773,919 A | 11/1973 | Boswell et al. |
| 3,969,287 A | 7/1976 | Jaworek et al. |
| 4,179,337 A | 12/1979 | Davis et al. |
| 4,195,128 A | 3/1980 | Hildebrand et al. |
| 4,229,537 A | 10/1980 | Hodgins et al. |
| 4,247,642 A | 1/1981 | Hirohara et al. |
| 4,301,144 A | 11/1981 | Iwashita et al. |
| 4,330,440 A | 5/1982 | Ayers et al. |
| 4,439,196 A | 3/1984 | Higuchi |
| 4,447,224 A | 5/1984 | DeCant, Jr. et al. |
| 4,447,233 A | 5/1984 | Mayfield |
| 4,475,196 A | 10/1984 | La Zor |
| 4,485,045 A | 11/1984 | Regen |
| 4,486,194 A | 12/1984 | Ferrara |
| 4,487,603 A | 12/1984 | Harris |
| 4,496,689 A | 1/1985 | Mitra |
| 4,544,545 A | 10/1985 | Ryan et al. |
| 4,596,556 A | 6/1986 | Morrow et al. |
| 4,640,835 A | 2/1987 | Shimizu et al. |
| 4,670,417 A | 6/1987 | Iwasaki et al. |
| 4,751,180 A | 6/1988 | Cousens et al. |
| 4,790,824 A | 12/1988 | Morrow et al. |
| 4,791,192 A | 12/1988 | Nakagawa et al. |
| 4,816,397 A | 3/1989 | Boss et al. |
| 4,816,567 A | 3/1989 | Cabilly et al. |
| 4,935,233 A | 6/1990 | Bell et al. |
| 4,941,880 A | 7/1990 | Burns |
| 4,946,778 A | 8/1990 | Ladner et al. |

(Continued)

FOREIGN PATENT DOCUMENTS

| | | |
|---|---|---|
| EP | 0 036 676 A1 | 9/1981 |
| EP | 0 088 046 A2 | 9/1983 |
| EP | 0 133 988 A2 | 3/1985 |
| EP | 0 143 949 A1 | 6/1985 |
| EP | 0171496 A2 | 2/1986 |

(Continued)

OTHER PUBLICATIONS

Lloyd et al (Protein Engineering, Design & Selection, 22:159-168, 2009).*
Edwards etal (J Mol Biol, 14;334(1):103-118, 2003).*
Mariuzza et al. (Annu. Rev. Biophys. Biophys. Chem., 16: 139-159, 1987).*
Lum etal (BBMT, 18:1012-1022, 2012).*

(Continued)

*Primary Examiner* — Brad Duffy
(74) *Attorney, Agent, or Firm* — Marshall, Gerstein & Borun LLP

(57) ABSTRACT

The present invention provides to a bispecific single chain antibody construct binding to a target cell surface antigen via a first binding domain and to the T cell surface antigen CD3 via a second binding domain, wherein serum albumin is fused to the C-terminus of the antibody construct. Moreover, the invention provides a polynucleotide encoding the antibody construct, a vector comprising said polynucleotide and a host cell transformed or transfected with said vector. Furthermore, the invention provides a process for the production of the antibody construct of the invention, a medical use of said antibody construct and a kit comprising said antibody construct.

12 Claims, 15 Drawing Sheets

Specification includes a Sequence Listing.

(56) References Cited

U.S. PATENT DOCUMENTS

| | | |
|---|---|---|
| 5,013,556 A | 5/1991 | Woodie et al. |
| 5,064,413 A | 11/1991 | McKinnon et al. |
| 5,223,409 A | 6/1993 | Ladner et al. |
| 5,225,539 A | 7/1993 | Winter |
| 5,292,658 A | 3/1994 | Cormier et al. |
| 5,312,335 A | 5/1994 | McKinnon et al. |
| 5,383,851 A | 1/1995 | McKinnon, Jr. et al. |
| 5,399,163 A | 3/1995 | Peterson et al. |
| 5,418,155 A | 5/1995 | Cormier et al. |
| 5,476,996 A | 12/1995 | Wilson et al. |
| 5,545,806 A | 8/1996 | Lonberg et al. |
| 5,545,807 A | 8/1996 | Surani et al. |
| 5,565,332 A | 10/1996 | Hoogenboom et al. |
| 5,569,825 A | 10/1996 | Lonberg et al. |
| 5,585,089 A | 12/1996 | Queen et al. |
| 5,591,669 A | 1/1997 | Krimpenfort et al. |
| 5,612,205 A | 3/1997 | Kay et al. |
| 5,625,126 A | 4/1997 | Lonberg et al. |
| 5,625,825 A | 4/1997 | Rostoker et al. |
| 5,633,425 A | 5/1997 | Lonberg et al. |
| 5,643,763 A | 7/1997 | Dunn et al. |
| 5,648,260 A | 7/1997 | Winter et al. |
| 5,661,016 A | 8/1997 | Lonberg et al. |
| 5,683,888 A | 11/1997 | Campbell |
| 5,693,761 A | 12/1997 | Queen et al. |
| 5,693,762 A | 12/1997 | Queen et al. |
| 5,698,767 A | 12/1997 | Wilson et al. |
| 5,721,367 A | 2/1998 | Kay et al. |
| 5,741,668 A | 4/1998 | Ward et al. |
| 5,770,429 A | 6/1998 | Lonberg et al. |
| 5,777,079 A | 7/1998 | Tsien et al. |
| 5,789,215 A | 8/1998 | Berns et al. |
| 5,789,650 A | 8/1998 | Lonberg et al. |
| 5,804,387 A | 9/1998 | Cormack et al. |
| 5,814,318 A | 9/1998 | Lonberg et al. |
| 5,859,205 A | 1/1999 | Adair et al. |
| 5,874,299 A | 2/1999 | Lonberg et al. |
| 5,874,304 A | 2/1999 | Zolotukhin et al. |
| 5,876,995 A | 3/1999 | Bryan |
| 5,877,397 A | 3/1999 | Lonberg et al. |
| 5,925,558 A | 7/1999 | Tsien et al. |
| 5,939,598 A | 8/1999 | Kucherlapati et al. |
| 5,958,765 A | 9/1999 | Brams et al. |
| 5,981,175 A | 11/1999 | Loring et al. |
| 6,023,010 A | 2/2000 | Krimpenfort et al. |
| 6,075,181 A | 6/2000 | Kucherlapati et al. |
| 6,114,598 A | 9/2000 | Kucherlapati et al. |
| 6,150,584 A | 11/2000 | Kucherlapati et al. |
| 6,162,963 A | 12/2000 | Kucherlapati et al. |
| 6,255,458 B1 | 7/2001 | Lonberg et al. |
| 6,300,064 B1 | 10/2001 | Knappik et al. |
| 6,407,213 B1 | 6/2002 | Carter et al. |
| 6,673,986 B1 | 1/2004 | Kucherlapati et al. |
| 9,089,615 B2 | 7/2015 | Stull et al. |
| 2002/0160004 A1 | 10/2002 | Lyman et al. |
| 2003/0070185 A1 | 4/2003 | Jakobovits et al. |
| 2011/0165161 A1* | 7/2011 | Lin ................. A61K 39/39558 424/135.1 |
| 2011/0275787 A1* | 11/2011 | Kufer ................. C07K 16/2803 530/324 |
| 2012/0328624 A1 | 12/2012 | Yoshida et al. |
| 2014/0128326 A1* | 5/2014 | Cameron ............. C07K 14/765 514/15.2 |
| 2014/0302037 A1 | 10/2014 | Borges et al. |
| 2014/0308285 A1 | 10/2014 | Yan et al. |
| 2014/0363455 A1 | 12/2014 | Stull et al. |
| 2014/0364590 A1 | 12/2014 | Stull et al. |
| 2015/0368343 A1 | 12/2015 | Xiao et al. |
| 2017/0029502 A1 | 2/2017 | Raum et al. |
| 2017/0029512 A1 | 2/2017 | Raum et al. |
| 2017/0037149 A1 | 2/2017 | Raum et al. |
| 2017/0037310 A1 | 2/2017 | Zhang et al. |
| 2017/0129961 A1 | 5/2017 | Raum et al. |
| 2017/0218077 A1 | 8/2017 | Raum et al. |
| 2017/0218078 A1 | 8/2017 | Raum et al. |
| 2017/0218079 A1 | 8/2017 | Raum et al. |

FOREIGN PATENT DOCUMENTS

| | | |
|---|---|---|
| EP | 0173494 | 3/1986 |
| EP | 0173494 A2 | 3/1986 |
| EP | 0 058 481 B1 | 10/1986 |
| EP | 0239400 A2 | 9/1987 |
| EP | 0463151 A1 | 1/1992 |
| EP | 0546073 A1 | 6/1993 |
| EP | 0773288 A2 | 5/1997 |
| EP | 0546073 B1 | 9/1997 |
| EP | 0843961 A1 | 5/1998 |
| GB | 2177096 A | 1/1987 |
| JP | 3 068 180 B2 | 7/2000 |
| JP | 3 068 506 B2 | 7/2000 |
| JP | 3 068 507 B2 | 7/2000 |
| JP | 2012-504402 A | 2/2012 |
| JP | 2017-522891 A | 8/2017 |
| WO | WO-87/005330 A1 | 9/1987 |
| WO | WO-1987/005330 A1 | 9/1987 |
| WO | WO-1988/009344 A1 | 12/1988 |
| WO | WO-1992/003918 A1 | 3/1992 |
| WO | WO-1992/015673 A1 | 9/1992 |
| WO | WO-1992/022645 A1 | 12/1992 |
| WO | WO-1992/022647 A1 | 12/1992 |
| WO | WO-1992/022670 A1 | 12/1992 |
| WO | WO-1993/012227 A1 | 6/1993 |
| WO | WO-93/015722 A1 | 8/1993 |
| WO | WO-1994/000569 A1 | 1/1994 |
| WO | WO-94/02602 A1 | 2/1994 |
| WO | WO-1994/002602 A1 | 2/1994 |
| WO | WO-1994/010308 A1 | 5/1994 |
| WO | WO-1994/025585 A1 | 11/1994 |
| WO | WO-1995/007463 A1 | 3/1995 |
| WO | WO-1996/014436 A1 | 5/1996 |
| WO | WO-96/33735 A1 | 10/1996 |
| WO | WO-96/34096 A1 | 10/1996 |
| WO | WO-1996/033735 A1 | 10/1996 |
| WO | WO-1996/034096 A1 | 10/1996 |
| WO | WO-1997/013852 A1 | 4/1997 |
| WO | WO-1997/038731 A1 | 10/1997 |
| WO | WO-1998/014605 A1 | 4/1998 |
| WO | WO-1998/024884 A1 | 6/1998 |
| WO | WO-1998/024893 A2 | 6/1998 |
| WO | WO-1998/026277 A2 | 6/1998 |
| WO | WO-1998/052976 A1 | 11/1998 |
| WO | WO-1999/049019 A2 | 9/1999 |
| WO | WO-1999/054440 A1 | 10/1999 |
| WO | WO-2000/006605 A2 | 2/2000 |
| WO | WO-2000/034317 A2 | 6/2000 |
| WO | WO-2000/076310 A1 | 12/2000 |
| WO | WO-2003/047336 A2 | 6/2003 |
| WO | WO-2004/003019 A2 | 1/2004 |
| WO | WO-2005/040220 A1 | 5/2005 |
| WO | WO-2006/138181 A2 | 12/2006 |
| WO | WO-2007/042261 A2 | 4/2007 |
| WO | WO-2007/098420 A2 | 8/2007 |
| WO | WO-2008/119567 A1 | 10/2008 |
| WO | WO-2009/127691 A1 | 10/2009 |
| WO | WO-201 0/037835 A2 | 4/2010 |
| WO | WO-2010/037838 A2 | 4/2010 |
| WO | WO-2011/051489 A2 | 5/2011 |
| WO | WO-2011/093097 A1 | 8/2011 |
| WO | 2011/121110 A1 | 10/2011 |
| WO | WO-2012/059486 A1 | 5/2012 |
| WO | WO-2012/150319 A1 | 11/2012 |
| WO | WO-2013/026833 A1 | 2/2013 |
| WO | WO-2013/026837 A1 | 2/2013 |
| WO | WO-2013/075066 A2 | 5/2013 |
| WO | WO-2013/126746 A2 | 8/2013 |
| WO | WO-2013/128027 A1 | 9/2013 |
| WO | WO-2013/135896 A1 | 9/2013 |
| WO | WO-201 4/072481 A1 | 5/2014 |
| WO | WO-2014/114800 A1 | 7/2014 |
| WO | WO-2014/125273 A1 | 8/2014 |
| WO | WO-2014/144722 A2 | 9/2014 |
| WO | WO-2014/151910 A1 | 9/2014 |
| WO | WO-2014140368 A1 * | 9/2014 ............. A61K 39/42 |

(56) References Cited

FOREIGN PATENT DOCUMENTS

| | | |
|---|---|---|
| WO | WO-2015/048272 A1 | 4/2015 |
| WO | WO-2016/016415 A1 | 2/2016 |
| WO | WO-2016/016859 A1 | 2/2016 |
| WO | WO-2017/134140 A1 | 8/2017 |

OTHER PUBLICATIONS

Andersen et al (JBC, 288(33):24277-24285, 2013).*
U.S. Appl. No. 08/486,859.
Arakawa et al., Solvent interactions in pharmaceutical formulations. *Pharm Res.* 8(3): 285-91 (1991).
Cheson et al., Report of an international workshop to standardize response criteria for nonHodgkin's lymphomas. NCI Sponsored International Working Group. *J. Clin. Oncol.* 17(4): 1244 (1999).
Cook et al., The human immunoglobulin VH repertoire. *Immunol. Today,* 16(5): 237-42 (1995).
Cunningham et al., High-resolution epitope mapping of hGH-receptor interactions by alanine-scanning mutagenesis. *Science,* 244: 1081-5 (1989).
Eppstein et al., Biological activity of liposome-encapsulated murine interferon γ is mediated by a cell membrane receptor. *Proc. Natl. Acad. Sci. USA* 82: 3688-92 (1985).
Gabizon et al., Pharmacokinetics and tissue distribution of doxorubicin encapsulated in stable liposomes with long circulation times. *J. Natl. Cancer Inst.* 8: 1484-8 (1989).
Graham et al., Characteristics of a human cell line transformed by DNA from human adenovirus type 5. *J. Gen Virol.* 36: 59-74 (1977).
Heim et al., Engineering green fluorescent protein for improved brightness, longer wavelengths and fluorescence resonance energy transfer. *Curr. Biol.* 6: 178-82 (1996).
Hiatt et al., Production of antibodies in transgenic plants. *Nature,* 342: 76-8 (1989).
Holliger et al., "Diabodies": small bivalent and bispecific antibody fragments. *Proc. Natl. Acad. Sci. USA,* 90(14): 6444-8 (1993).
Huston et al., Protein engineering of antibody binding sites: recovery of specific activity in an antidigoxin single-chain Fv analogue produced in *Escherichia coli. Proc. Natl. Acad. Sci. USA* 85: 5879-83 (1988).
Hwang et al., Hepatic uptake and degradation of unilamellar sphingomyelin/cholesterol liposomes: A kinetic study. *Proc. Natl. Acad. Sci. USA* 77: 4030-4 (1980).
Ichiki et al., Regulation of the expression of human C epsilon germline transcript. Identification of a novel IL-4 responsive element. *J. Immunol.* 150: 5408-17 (1993).
Karlin et al., Applications and statistics for multiple high-scoring segments in molecular sequences. *Proc. Natl. Acad. Sci. USA,* 90: 5873-7 (1993).
Kaufman, Selection and coamplification of heterologous genes in mammalian cells. *Meth. Enzymol.* 185: 537-66 (1990).
Kipriyanov et al., Bispecific tandem diabody for tumor therapy with improved antigen binding and pharmacokinetics. *J. Mol. Biol.* 293: 41-56 (1999).
Kohler et al., Continuous cultures of fused cells secreting antibody of predefined specificity. *Nature* 256:495-7 (1975).
Kozbor et al., The production of monoclonal antibodies from human lymphocytes. *Immunol. Today* 4(3): 72-9 (1983).
Kumar et al., Molecular cloning and expression of the Fabs of human autoantibodies in *Escherichia coli.* Determination of the heavy or light chain contribution to the anti-DNA/-cardiolipin activity of the Fab, *J. Biol. Chem.* 275:35129-36 (2000).
Langer et al., Biocompatibility of polymeric delivery systems for macromolecules. *J. Biomed. Mater. Res.* 15(2): 267-77 (1981).
Langer, Controlled release of macromolecules. *Chem. Tech.* 12: 98-105 (1982).
Lowman et al., Selecting high-affinity binding proteins by monovalent phage display. *Biochemistry* 30: 10832-7(1991).
Martin et al., Irreversible coupling of immunoglobulin fragments to preformed vesicles. *J. Biol. Chem.* 257: 286-8 (1982).

Morrison et al., Chimeric human antibody molecules: mouse antigen-binding domains with human constant region domains. *Proc. Natl. Acad. Sci. USA,* 81: 6851-5 (1984).
Nolan et al., Fluorescence-activated cell analysis and sorting of viable mammalian cells based on beta-D-galactosidase activity after transduction of Escherichia coli lacZ. Proc. Natl. Acad. Sci. USA85:2603-7(1988).
Owen et al., Synthesis of a functional anti-phytochrome single-chain Fv protein in transgenic tobacco. *Bio/Technology* 10: 790-4 (1992).
Randolph et al., Surfactant-protein interactions. *Pharm Biotechnol*13: 159-75 (2002).
Raum et al., Anti-self antibodies selected from a human IgD heavy chain repertoire: a novel approach to generate therapeutic human antibodies against tumor-associated differentiation antigens. *Cancer Immunol. Immunother.* 50: 141-50 (2001).
Riechmann et al., Reshaping human antibodies for therapy. *Nature,* 332: 323-9 (1988).
Schier et al., Efficient in vitro affinity maturation of phage antibodies using BIAcore guided selections. *Hum. Antibodies Hybridomas* 7(3): 97-105 (1996).
Schlereth et al., T-cell activation and B-cell depletion in chimpanzees treated with a bispecific anti-CD19/anti-CD3 single-chain antibody construct. *Cancer Immunol. Immunother.* 55: 503-14 (2006).
Sidman et al., Controlled release of macromolecules and pharmaceuticals from synthetic polypeptides based on glutamic acid. *Biopolymers* 2: 547-56 (1983).
Smith-Gill et al., Contributions of immunoglobulin heavy and light chains to antibody specificity for lysozyme and two haptens, *J. Immunol.* 139:4135-44 (1987).
Song et al., Light chain of natural antibody plays a dominant role in protein antigen binding, *Biochem. Biophys. Res. Common.* 390-4 (2000).
Stauber et al., Development and applications of enhanced green fluorescent protein mutants. *Biotechniques* 24: 462-71 (1998).
Takeda et al., Construction of chimaeric processed immunoglobulin genes containing mouse variable and human constant region sequences. *Nature,* 314: 452-4 (1985).
Thotakura et al., Enzymatic deglycosylation of glycoproteins. *Meth. Enzymol.* 138: 350-9 (1987).
Topp et al., Long-term follow-up of hematologic relapse-free survival in a phase 2 study of blinatumomab in patients with MRD in B-lineage ALL. *Blood,* 120(26): 5185-7 (2012).
U.S. Appl. No. 07/466,008, Kucherlapati et al.
U.S. Appl. No. 07/574,748, Kay et al.
U.S. Appl. No. 07/575,962, Lonberg et al.
U.S. Appl. No. 07/610,515, Kucherlapati et al.
U.S. Appl. No. 07/904,068, Lonberg et al.
U.S. Appl. No. 07/919,297, Kucherlapati et al.
U.S. Appl. No. 08/112,848, Kucherlapati et al.
U.S. Appl. No. 08/155,301, Lonberg et al.
U.S. Appl. No. 08/161,739, Lonberg et al.
U.S. Appl. No. 08/165,699, Lonberg et al.
U.S. Appl. No. 08/209,741, Kay et al.
U.S. Appl. No. 08/234,145, Kucherlapati et al.
U.S. Appl. No. 08/376,279, Kucherlapati et al.
U.S. Appl. No. 08/430,938, Kucherlapati et al.
U.S. Appl. No. 08/462,837, Kucherlapati et al.
U.S. Appl. No. 08/463,191, Kucherlapati et al.
U.S. Appl. No. 08/464,584, Kucherlapati et al.
U.S. Appl. No. 08/486,853, Kucherlapati et al.
U.S. Appl. No. 08/486,859, Kucherlapati et al.
U.S. Appl. No. 08/759,620, Jakobovits et al.
Altschul et al., Basic local alignment tool. *J. Mol. Biol.* 215: 403-10 (1990).
Altschul et al., Gapped BLAST and PSI-BLAST: a new generation of protein database search programs. Nucl. Acids Res. 25(17): 3389-402 (1997).
Altschul et al., Local alignment statistics. *Meth. Enzymol.* 266: 460-80 (1996).
Andersen et al., Extending serum half-life of albumin by engineering FcRn binding. *J. Biol. Chem.* 289(19): 13492-502 (2014).

(56) References Cited

OTHER PUBLICATIONS

Aplin et al., Preparation, properties, and applications of carbohydrate conjugates of proteins and lipids. CRC Grit. Rev. Biochem. 259-306 (1981).
Artsaenko et al., The expression of a single-chain Fv antibody against abscisic acid creates a wilty phenotype in transgenic tobacco. *The Plant J.* 8: 745-50 (1995).
Brühl et al., Depletion of CCR5-expressing cells with bispecific antibodies and chemokine toxins: a new strategy in the treatment of chronic inflammatory diseases and HIV. *Immunol.* 166: 2420-6 (2001).
Carter et al., High level *Escherichia coli* expression and production of a bivalent humanized antibody fragment. *Biotechnology* 10: 163-7 (1992).
Chalfie et al., Green fluorescent protein as a marker for gene expression. *Science* 263: 802-5 (1994).
Cheadle et al., Cloning and expression of the variable regions of mouse myeloma protein MOPC315 in *E. coli*: recovery of active FV fragments. *Mol. Immunol.* 29: 21-30 (1992).
Chothia et al., Canonical structures for the hypervariable regions of immunoglobulins. *J. Mol. Biol.* 196: 901-17 (1987).
Chothia et al., Conformation of immunoglobulin hypervariable regions. *Nature* 342: 877-83 (1989).
Clackson et al., Making antibody fragments using phage display libraries. *Lett. Nature* 352: 624-8 (1991).
Dall'Acqua et al., Contribution of domain interface residues to the stability of antibody CH3 domain homodimers. *Biochemistry* 37: 9266-73 (1998).
Devereux et al., A comprehensive set of sequence analysis programs for the VAX. *Nucl. Acid. Res.* 12: 387-95 (1984).
Duskin et al., Relationship of the structure and biological activity of the natural homologues of tunicamycin. *J. Biol. Chem.* 257(6): 3105-9 (1982).
Edge et al., Deglycosylation of glycoproteins by trifluoromethanesulfonic acid. *Anal. Biochem.* 118: 131-7(1981).
Fanslow et al., Structural characteristics of CD40 ligand that determine biological function. *Semin. Immunol.* 6: 267-78 (1994).
Fecker et al., Expression of single-chain antibody fragments (scFv) specific for beet necrotic yellow vein virus coat protein or 25 kDa protein in *Escherichia coli* and *Nicotiana benthamiana*. *Plant Mol. Biol.* 32: 979-86 (1996).
Feng et al., Progressive sequence alignment as a prerequisite to correct phylogenetic trees. *J. Mol. Evol.*... 35: 351-60 (1987).
Green et al., Antigen-specific human monoclonal antibodies from mice engineered with human Ig heavy and light chain YACs. *Nat. Genet.* 7: 13-21 (1994).
Green et al., Regulation of B cell development by variable gene complexity in mice reconstituted with human immunoglobulin yeast artificial chromosomes. *J. Exp. Med.* 188: 483-95 (1998).
Hakimuddin et al., A chemical method for the deglycosylation of proteins. *Arch. Biochem. Biophys.* 259: 52-7 (1987).
Hawkins et al., Selection of phage antibodies by binding affinity. *J. Mol. Biol.* 254: 889-96 (1992).
Higgins et al., Fast and sensitive multiple sequence alignments on a microcomputer. *CABIOS* 5: 151-3(1989).
Hoppe et al., A parallel three stranded alpha-helical bundle at the nucleation site of collagen triple-helix formation. *FEBS Lett.* 344: 191-5 (1994).
Jones et al., Replacing the complementarity-determine regions in a human antibody with those from a mouse. *Nature*, 321: 522-5 (1986).
Knappe et al., Herpesvirus saimiri-transformed macaque T cells are tolerated and do not cause lymphoma after autologous reinfusion. *Blood* 95(10): 3256-61 (2000).
Kufer et al., A revival of bispecific antibodies. *Trends Biotechnol.* 22(5): 238-44 (2004).
Kufer et al., Construction and biological activity of a recombinant bispecific single-chain antibody designed for therapy of minimal residual colorectal cancer. *Cancer Immunol. Immunother.* 45: 193-7 (1997).
Landschulz et al., The leucine zipper: a hypothetical structure common to a new class of DNA binding proteins. *Science*, 240: 1759-64 (1988).
Löffler et al., A recombinant bispecific single-chain antibody, CD19 x CD3, induces rapid and high lymphoma-directed cytotoxicity by unstimulated T lymphocytes. *Blood* 95(6): 2098-103 (2000).
MacCallum et al., Antibody-antigen intractions: Contact analysis and binding site technology. *J. Mol. Biol.* 262: 732-45 (1996).
Mack et al., A small bispecific antibody construct expressed as a functional single-chain molecule with high tumor cell cytotoxicity. *Proc. Natl. Acad. Sci. USA* 92(15): 7021-5 (1995).
Mack et al., Biologic properties of a bispecific single-chain antibody directed against 17-1A (EpCAM) and CD3: tumor cell-dependent T cell stimulation and cytotoxic activity. J. Immunol. 158: 3965-70(1997).
Malmborg et al., BIAcore as a tool in antibody engineering. *J. Immunol. Meth.* 183: 7-13 (1995).
Marks et al., By-passing immunization: Human antibodies from V-gene libraries displayed on phage. *J. Mol. Biol.* 222:581-97 (1991).
Martin et al., Structural families in loops of homologous proteins: automatic classification, modelling and application to antibodies. *J. Mol. Biol.* 263: 800-15 (1996).
Mather et al., Culture of testicular cells in hormone-supplemented serum-free medium. *Ann. N.Y. Acad. Sci.* 383: 44-68 (1982).
Mather, Establishment and characterization of two distinct mouse testicular epithelial cell lines. *Biol. Reprod.* 23: 243-51 (1980).
Mendez et al., Functional transplant of megabase human immunoglobulin loci recapitulates human antibody response in mice. *Nat. Genet.* 15: 146-56 (1997).
Morrison, Transfectomas provide novel chimeric antibodies. *Science*, 229(4719): 1202-7 (1985).
Mueller et al., Improved pharmacokinetics of recombinant bispecific antibody molecules by fusion to human serum albumin. *J. Bio. Chem.* 282(17): 12650-60 (2007).
Needleman et al., A general method applicable to the search for similarities in the amino acid sequence of two proteins. *J. Mol. Biol.* 48: 443-53 (1970).
Olsson et al., Human-human monoclonal antibody-producing hybridomas: Technical aspects. *Meth. Enzymol.* 92: 3-16 (1982).
Pearson et al., Improved tools for biological sequence comparison. *Proc. Natl. Acad. Sci. USA* 85:2444-8 (1988).
Presta, Antibody engineering. *Curr. Op. Struct. Biol.* 2: 593-6 (1992).
Raag et al., Single-chain Fvs. *FASEB J.* 9(1): 73-80 (1995).
Smith et al., Comparison of biosequences. *Adv. Appl. Math.* 2: 482-9 (1981).
Smith, Filamentous fusion phage: Novel expression vectors that display cloned antigens on the virion surface. *Science* 228: 1315-7 (1985).
Songsivilai et al., Bispecific antibody: a tool for diagnosis and treatment of disease. *Clin. Exp. Immunol.* 79: 315-21 (1990).
Teng et al., Construction and testing of mouse—human heteromyelomas for human monoclonal antibody production. *Proc. Natl. Acad. Sci. USA* 80: 7308-12 (1983).
Tomlinson et al., The repertoire of human germline VH sequences reveals about fifty groups of VH segments with different hypervariable loops. *J. Mol. Biol.* 227: 776-98 (1992).
Tomlinson et al., The structural repertoire of the human V kappa domain. *EMBO J.* 14: 4628-38 (1995).
Urlaub et al., Isolation of Chinese hamster cell mutants deficient in dihydrofolate reductase activity. *Proc. Natl. Acad. Sci. USA* 77: 4216-20 (1980).
International Preliminary Report on Patentability for Corresponding International Application No. PCT/IB2015/055815, dated Oct. 18, 2016, 20 pages.
International Search Report and Written Opinion for Corresponding International Application No. PCT/IB2015/055815, dated Oct. 29, 2015, 11 pages.

* cited by examiner

OPTIMIZED CROSS-SPECIES SPECIFIC BISPECIFIC SINGLE CHAIN ANTIBODY CONTRUCTS

FIELD OF THE INVENTION

The present invention relates to a bispecific single chain antibody construct binding to a target cell surface antigen via a first binding domain and to the T cell surface antigen CD3 via a second binding domain, wherein serum albumin is fused to the C-terminus of the antibody construct. Moreover, the invention provides a polynucleotide encoding the antibody construct, a vector comprising said polynucleotide and a host cell transformed or transfected with said vector. Furthermore, the invention provides a process for the production of the antibody construct of the invention, a medical use of said antibody construct and a kit comprising said antibody construct.

BACKGROUND OF THE INVENTION

Bispecific molecules such as BiTE® (bispecific T cell engager) antibodies are recombinant protein constructs made from two flexibly linked antibody derived binding domains. One binding domain of BiTE® antibodies is specific for a selected tumor-associated surface antigen on target cells; the second binding domain is specific for CD3, a subunit of the T cell receptor complex on T cells. By their particular design BiTE® antibodies are uniquely suited to transiently connect T cells with target cells and, at the same time, potently activate the inherent cytolytic potential of T cells against target cells. An important further development of the first generation of BiTE® molecules (see WO 99/54440 and WO 2005/040220) developed into the clinic as AMG 103 and AMG 110 was the provision of bispecific antibody constructs binding to a context independent epitope at the N-terminus of the CD3E chain (WO 2008/119567). BiTE® antibodies binding to this elected epitope did not only show cross-species specificity for human and *Callithrix jacchus, Saguinus oedipus* or *Saimiri sciureus* CD3ε chain, but also, due to using this epitope instead of previously described epitopes for CD3 binders in bispecific T cell engaging molecules, do not activate T cells to the same degree as observed for the previous generation of T cell engaging antibodies. This difference in T cell activation was connected with less or reduced T cell redistribution in patients, which was identified as a risk for side effects.

Definitions

It must be noted that as used herein, the singular forms "a", "an", and "the", include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within ±20%, preferably within ±15%, more preferably within ±10%, and most preferably within ±5% of a given value or range.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein any of the terms "comprising", "consisting essentially of" and "consisting of" may be replaced with either of the other two terms.

DETAILED DESCRIPTION OF THE INVENTION

For bispecific T cell engaging molecules comprising as their T cell binding entity a binding domain specific for the human and *Callithrix jacchus, Saguinus oedipus* or *Saimiri sciureus* CD3ε chain, wherein the epitope is part of an amino acid sequence comprised in the group consisting of SEQ ID NOs: 7, 8, 9, and 10 and comprises at least the amino acid sequence Gln-Asp-Gly-Asn-Glu (SEQ ID NO: 1), it was observed that those molecules when used in extremely high concentration showed T cell cytotoxicity, independent of the target specificity of the second binding domain and even in the absence of target cells. Although those high concentrations of bispecific T cell engaging molecules are not relevant for every combination of disease and target in a treatment using the mode of action of T cell engaging molecules in case of a continuous i.v. administration, such high concentration issues may become relevant for specific administration routes or in combination with specific target settings and required compound concentrations.

Thus, the problem underlying the present invention was to provide bispecific single chain antibody constructs using a T cell binding domain of the latest generation, which avoid the T cell cytotoxicity even in high compound concentrations.

This problem was solved by providing a bispecific single chain antibody construct binding to a target cell surface antigen via a first binding domain and the T cell surface antigen CD3 via a second binding domain, wherein:

the second binding domain binds to an epitope of human and *Callithrix jacchus, Saguinus oedipus* or *Saimiri sciureus* CD3ε chain, wherein the epitope is part of an amino acid sequence comprised in the group consisting of SEQ ID NO: 7 (human), SEQ ID NO: 8 (*Callithrix jacchus*), SEQ ID NO: 9 (*Saguinus oedipus*), and SEQ ID NO: 10 (*Saimiri sciureus*) and comprises at least the amino acid sequence Gln-Asp-Gly-Asn-Glu (SEQ ID NO: 1). and a serum albumin is fused to the C-terminus of the antibody construct;

wherein the bispecific single chain antibody construct does not have an amino acid sequence as depicted in SEQ ID NOs: 2 and 3.

Without the intention to be bound by theory, the activation of T cells in the presence of a high concentration of the T cell engaging bispecific antibody constructs and in the absence of target cells is explained by dimerization or multimerization of the antibody constructs via the CD3 binding domain. Such di- or multimerization is sterically impaired by the fusion of an albumin or variant thereof to the C terminus of the antibody construct, while maintaining the characteristics of the antibody construct for its T cell engaging mode of action.

Those high concentrations of the T cell engaging bispecific antibody constructs in a patient are those concentrations in a specific compartment such as the serum. The fusion of the albumin to the C-terminus of the T cell engaging antibody construct prevents the activation of T cells in the absence of target cells up to a concentration of 2 mg/ml, at least up to 1 mg/ml, more preferably up to 500 ng/ml.

*Callithrix jacchus* and *Saguinus oedipus* are both new world primate belonging to the family of Callitrichidae, while *Saimiri sciureus* is a new world primate belonging to the family of Cebidae.

Serum albumin is a protein physiologically produced by the liver; it occurs dissolved in blood plasma and is the most abundant blood protein in mammals. Albumin is essential for maintaining the oncotic pressure needed for proper distribution of body fluids between blood vessels and body tissues. It also acts as a plasma carrier by non-specifically binding several hydrophobic steroid hormones and as a transport protein for hemin and fatty acids. The term "serum albumin" respectively the human variant thereof ("human albumin") defines in the context of the invented proteins either the parental human serum albumin protein (sequence as described in SEQ ID NO: 4) or any variant (e.g. such as albumin protein as depicted in SEQ ID NOs: 5-12 or 608 to 628) or fragment thereof preferably expressed as genetic fusion proteins and by chemical crosslinking etc. at least with one therapeutic protein. Variants comprising single or multiple mutations or fragments of albumin provide improved properties such as affinities to FcRn receptor and extended plasma half-life compared to its parent or reference. A preferred group of serum albumin sequences in connection with this invention is selected from a group consisting of SEQ ID NOs: 4, 6, 7, 8, 9, 10, 11, 12, 608, 609, 611, 612, 613, 614, 615, 616, 617, 618, 619, 621, 622, 623, 624, 625, 626, 627, and 628.

The term "antibody construct" refers to a molecule in which the structure and/or function is/are based on the structure and/or function of an antibody, e.g. of a full-length or whole immunoglobulin molecule. An antibody construct is hence capable of binding to its specific target or antigen. Furthermore, an antibody construct according to the invention comprises the minimum structural requirements of an antibody which allow for the target binding. This minimum requirement may e.g. be defined by the presence of at least the three light chain CDRs (i.e. CDR1, CDR2 and CDR3 of the VL region) and/or the three heavy chain CDRs (i.e. CDR1, CDR2 and CDR3 of the VH region). The antibodies on which the constructs according to the invention are based include for example monoclonal, recombinant, chimeric, deimmunized, humanized and human antibodies.

Within the definition of "antibody constructs" according to the invention are full-length or whole antibodies including camelid antibodies and other immunoglobulin antibodies generated by biotechnological or protein engineering methods or processes. These full-length antibodies may be for example monoclonal, recombinant, chimeric, deimmunized, humanized and human antibodies. Also within the definition of "antibody constructs" are fragments of full-length antibodies, such as VH, VHH, VL, (s)dAb, Fv, Fd, Fab, Fab', F(ab')2 or "r IgG" ("half antibody"). Antibody constructs according to the invention may also be modified fragments of antibodies, also called antibody variants, such as scFv, di-scFv or bi(s)-scFv, scFv-Fc, scFv-zipper, scFab, Fab2, Fab3, diabodies, single chain diabodies, tandem diabodies (Tandab's), tandem di-scFv, tandem tri-scFv, "minibodies" exemplified by a structure which is as follows: (VH-VL-CH3)2, (scFv-CH3)2 or (scFv-CH3-scFv)2, multibodies such as triabodies or tetrabodies, and single domain antibodies such as nanobodies or single variable domain antibodies comprising merely one variable domain, which might be VHH, VH or VL, that specifically bind an antigen or epitope independently of other V regions or domains.

Furthermore, the definition of the term "antibody constructs" includes monovalent, bivalent and polyvalent/multivalent constructs and, thus, monospecific constructs, specifically binding to only one antigenic structure, as well as bispecific and polyspecific/multispecific constructs, which specifically bind more than one antigenic structure, e.g. two, three or more, through distinct binding domains. Moreover, the definition of the term "antibody constructs" includes molecules consisting of only one polypeptide chain as well as molecules consisting of more than one polypeptide chain, which chains can be either identical (homodimers, homotrimers or homo oligomers) or different (heterodimer, heterotrimer or heterooligomer). Examples for the above identified antibodies and variants or derivatives thereof are described inter alia in Harlow and Lane, Antibodies a laboratory manual, CSHL Press (1988) and Using Antibodies: a laboratory manual, CSHL Press (1999), Kontermann and Dübel, Antibody Engineering, Springer, 2nd ed. 2010 and Little, Recombinant Antibodies for Immunotherapy, Cambridge University Press 2009.

The antibody constructs of the present invention are preferably "in vitro generated antibody constructs". This term refers to an antibody construct according to the above definition where all or part of the variable region (e.g., at least one CDR) is generated in a non-immune cell selection, e.g., an in vitro phage display, protein chip or any other method in which candidate sequences can be tested for their ability to bind to an antigen. This term thus preferably excludes sequences generated solely by genomic rearrangement in an immune cell in an animal. A "recombinant antibody" is an antibody made through the use of recombinant DNA technology or genetic engineering.

The present invention is directed to "single chain antibody constructs". Accordingly, those single chain antibody constructs only include those embodiments of the above described antibody constructs, which consist of a single peptide chain.

The term "monoclonal antibody" (mAb) or monoclonal antibody construct as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site or determinant on the antigen, in contrast to conventional (polyclonal) antibody preparations which typically include different antibodies directed against different determinants (or epitopes). In addition to their specificity, the monoclonal antibodies are advantageous in that they are synthesized by the hybridoma culture, hence uncontaminated by other immunoglobulins. The modifier "monoclonal" indicates the character of the antibody as being obtained from a substantially homogeneous population of antibodies, and is not to be construed as requiring production of the antibody by any particular method.

For the preparation of monoclonal antibodies, any technique providing antibodies produced by continuous cell line cultures can be used. For example, monoclonal antibodies to be used may be made by the hybridoma method first described by Koehler et al., Nature, 256: 495 (1975), or may be made by recombinant DNA methods (see, e.g., U.S. Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96).

Hybridomas can then be screened using standard methods, such as enzyme-linked immunosorbent assay (ELISA) and surface plasmon resonance (BIACORE™) analysis, to identify one or more hybridomas that produce an antibody that specifically binds with a specified antigen. Any form of the relevant antigen may be used as the immunogen, e.g., recombinant antigen, naturally occurring forms, any variants or fragments thereof, as well as an antigenic peptide thereof. Surface plasmon resonance as employed in the BIAcore system can be used to increase the efficiency of phage antibodies which bind to an epitope of a target antigen, such as the target cell surface antigen or CD3 epsilon (Schier, Human Antibodies Hybridomas 7 (1996), 97-105; Malmborg, J. Immunol. Methods 183 (1995), 7-13).

Another exemplary method of making monoclonal antibodies includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., XENOMOUSE™, Green et al. (1994) Nature Genetics 7:13-21, US 2003-0070185, WO 96/34096, and WO96/33735.

A monoclonal antibody can also be obtained from a non-human animal, and then modified, e.g., humanized, deimmunized, rendered chimeric etc., using recombinant DNA techniques known in the art. Examples of modified antibody constructs include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dübel (2010), loc. cit. and Little (2009), loc. cit.).

In immunology, affinity maturation is the process by which B cells produce antibodies with increased affinity for antigen during the course of an immune response. With repeated exposures to the same antigen, a host will produce antibodies of successively greater affinities. Like the natural prototype, the in vitro affinity maturation is based on the principles of mutation and selection. The in vitro affinity maturation has successfully been used to optimize antibodies, antibody constructs, and antibody fragments. Random mutations inside the CDRs are introduced using radiation, chemical mutagens or error-prone PCR. In addition, the genetical diversity can be increased by chain shuffling. Two or three rounds of mutation and selection using display methods like phage display usually results in antibody fragments with affinities in the low nanomolar range.

A preferred type of an amino acid substitutional variation of the antibody constructs involves substituting one or more hypervariable region residues of a parent antibody (e. g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e. g. 6-7 sites) are mutated to generate all possible amino acid substitutions at each site. The antibody variants thus generated are displayed in a monovalent fashion from filamentous phage particles as fusions to the gene III product of M13 packaged within each particle. The phage-displayed variants are then screened for their biological activity (e. g. binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human the target cell surface antigen. Such contact residues and neighboring residues are candidates for substitution according to the techniques elaborated herein. Once such variants are generated, the panel of variants is subjected to screening as described herein and antibodies with superior properties in one or more relevant assays may be selected for further development.

The monoclonal antibodies and antibody constructs of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is/are identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81: 6851-6855 (1984)). Chimeric antibodies of interest herein include "primitized" antibodies comprising variable domain antigen-binding sequences derived from a non-human primate (e.g., Old World Monkey, Ape etc.) and human constant region sequences. A variety of approaches for making chimeric antibodies have been described. See e.g., Morrison et al., Proc. Natl. Acad. ScL U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494; and GB 2177096.

An antibody, antibody construct or antibody fragment may also be modified by specific deletion of human T cell epitopes (a method called "deimmunization") by the methods disclosed in WO 98/52976 and WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences are disclosed e.g. in Tomlinson, et al. (1992) J. Mol. Biol. 227:776-798; Cook, G. P. et al. (1995) Immunol. Today Vol. 16 (5): 237-242; and Tomlinson et al. (1995) EMBO J. 14: 14:4628-4638. The V BASE directory provides a comprehensive directory of human immunoglobulin variable region sequences (compiled by Tomlinson, L A. et al. MRC Centre for Protein Engineering, Cambridge, UK). These sequences can be used as a source of human sequence, e.g., for framework regions and CDRs. Consensus human framework regions can also be used, for example as described in U.S. Pat. No. 6,300,064.

"Humanized" antibodies, antibody constructs or fragments thereof (such as Fv, Fab, Fab', F(ab')2 or other antigen-binding subsequences of antibodies) are antibodies or immunoglobulins of mostly human sequences, which contain (a) minimal sequence(s) derived from non-human immunoglobulin. For the most part, humanized antibodies are human immunoglobulins (recipient antibody) in which residues from a hypervariable region (also CDR) of the recipient are replaced by residues from a hypervariable region of a non-human (e.g., rodent) species (donor antibody) such as mouse, rat, hamster or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody may also comprise at least a portion of an immunoglobulin constant region (Fc), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992).

Humanized antibodies or fragments thereof can be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. Nos. 5,585,089; 5,693,761; 5,693,762; 5,859,205; and 6,407,213. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector.

Humanized antibodies may also be produced using transgenic animals such as mice that express human heavy and light chain genes, but are incapable of expressing the endogenous mouse immunoglobulin heavy and light chain genes. Winter describes an exemplary CDR grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al., Meth. Enzymol., 92: 3-16, 1982, and EP 239 400.

The term "human antibody", "human antibody construct" and "human binding domain" includes antibodies, antibody constructs and binding domains having antibody regions such as variable and constant regions or domains which correspond substantially to human germline immunoglobulin sequences known in the art, including, for example, those described by Kabat et al. (1991) (loc. cit.). The human antibodies, antibody constructs or binding domains of the invention may include amino acid residues not encoded by human germline immunoglobulin sequences (e.g., mutations introduced by random or site-specific mutagenesis in vitro or by somatic mutation in vivo), for example in the CDRs, and in particular, in CDR3. The human antibodies, antibody constructs or binding domains can have at least one, two, three, four, five, or more positions replaced with an amino acid residue that is not encoded by the human germline immunoglobulin sequence. The definition of human antibodies, antibody constructs and binding domains as used herein also contemplates fully human antibodies, which include only non-artificially and/or genetically altered human sequences of antibodies as those can be derived by using technologies or systems such as the Xenomouse.

In some embodiments, the antibody constructs of the invention are "isolated" or "substantially pure" antibody constructs. "Isolated" or "substantially pure" when used to describe the antibody construct disclosed herein means an antibody construct that has been identified, separated and/or recovered from a component of its production environment. Preferably, the antibody construct is free or substantially free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. The antibody constructs may e.g. constitute at least about 5%, or at least about 50% by weight of the total protein in a given sample. It is understood that the isolated protein may constitute from 5% to 99.9% by weight of the total protein content, depending on the circumstances. The polypeptide may be made at a significantly higher concentration through the use of an inducible promoter or high expression promoter, such that it is made at increased concentration levels. The definition includes the production of an antibody construct in a wide variety of organisms and/or host cells that are known in the art. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody construct will be prepared by at least one purification step.

The term "binding domain" characterizes in connection with the present invention a domain which (specifically) binds to/interacts with/recognizes a given target epitope or a given target site on the target molecules (antigens) and CD3, respectively. The structure and function of the first binding domain (recognizing the target cell surface antigen), and preferably also the structure and/or function of the second binding domain (CD3), is/are based on the structure and/or function of an antibody, e.g. of a full-length or whole immunoglobulin molecule. According to the invention, the first binding domain is characterized by the presence of three light chain CDRs (i.e. CDR1, CDR2 and CDR3 of the VL region) and three heavy chain CDRs (i.e. CDR1, CDR2 and CDR3 of the VH region). The second binding domain preferably also comprises the minimum structural requirements of an antibody which allow for the target binding. More preferably, the second binding domain comprises at least three light chain CDRs (i.e. CDR1, CDR2 and CDR3 of the VL region) and/or three heavy chain CDRs (i.e. CDR1, CDR2 and CDR3 of the VH region). It is envisaged that the first and/or second binding domain is produced by or obtainable by phage-display or library screening methods rather than by grafting CDR sequences from a pre-existing (monoclonal) antibody into a scaffold.

According to the present invention, binding domains are preferably in the form of polypeptides. Such polypeptides may include proteinaceous parts and non-proteinaceous parts (e.g. chemical linkers or chemical cross-linking agents such as glutaraldehyde). Proteins (including fragments thereof, preferably biologically active fragments, and peptides, usually having less than 30 amino acids) comprise two or more amino acids coupled to each other via a covalent peptide bond (resulting in a chain of amino acids). The term "polypeptide" as used herein describes a group of molecules, which usually consist of more than 30 amino acids. Polypeptides may further form multimers such as dimers, trimers and higher oligomers, i.e. consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "peptide", "polypeptide" and "protein" also refer to naturally modified peptides/polypeptides/proteins wherein the modification is effected e.g. by post-translational modifications like glycosylation, acetylation, phosphorylation and the like. A "peptide", "polypeptide" or "protein" when referred to herein may also be chemically modified such as pegylated. Such modifications are well known in the art and described herein below.

As mentioned above, a binding domain may typically comprise an antibody light chain variable region (VL) and an antibody heavy chain variable region (VH); however, it does not have to comprise both. Fd fragments, for example, have two VH regions and often retain some antigen-binding function of the intact antigen-binding domain. Examples of (modified) antigen-binding antibody fragments include (1) a Fab fragment, a monovalent fragment having the VL, VH, CL and CH1 domains; (2) a F(ab')2 fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from an scFv-library).

Antibodies and antibody constructs comprising at least one human binding domain avoid some of the problems associated with antibodies or antibody constructs that possess non-human such as rodent (e.g. murine, rat, hamster or rabbit) variable and/or constant regions. The presence of such rodent derived proteins can lead to the rapid clearance of the antibodies or antibody constructs or can lead to the generation of an immune response against the antibody or antibody construct by a patient. In order to avoid the use of rodent derived antibodies or antibody constructs, human or fully human antibodies/antibody constructs can be generated through the introduction of human antibody function into a rodent so that the rodent produces fully human antibodies.

The ability to clone and reconstruct megabase-sized human loci in YACs and to introduce them into the mouse germline provides a powerful approach to elucidating the functional components of very large or crudely mapped loci as well as generating useful models of human disease. Furthermore, the use of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies or antibody constructs are expected to minimize the immunogenic and allergic responses intrinsic to mouse or mouse-derivatized mAbs and thus to increase the efficacy and safety of the administered antibodies/antibody constructs. The use of fully human antibodies or antibody constructs can be expected to provide a substantial advantage in the treatment of chronic and recurring human diseases, such as inflammation, autoimmunity, and cancer, which require repeated compound administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with the generation of the first XenoMouse mouse strains (see Green et al. Nature Genetics 7:13-21 (1994)). The XenoMouse strains were engineered with yeast artificial chromosomes (YACs) containing 245 kb and 190 kb-sized germline configuration fragments of the human heavy chain locus and kappa light chain locus, respectively, which contained core variable and constant region sequences. The human Ig containing YACs proved to be compatible with the mouse system for both rearrangement and expression of antibodies and were capable of substituting for the inactivated mouse Ig genes. This was demonstrated by their ability to induce B cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions might recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620.

The production of the XenoMouse mice is further discussed and delineated in U.S. patent application Ser. Nos. 07/466,008, 07/610,515, 07/919,297, 07/922,649, 08/031,801, 08/112,848, 08/234,145, 08/376,279, 08/430,938, 08/464,584, 08/464,582, 08/463,191, 08/462,837, 08/486,853, 08/486,857, 08/486,859, 08/462,513, 08/724,752, and 08/759,620; and U.S. Pat. Nos. 6,162,963, 6,150,584, 6,114,598, 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998), EP 0 463 151 B1, WO 94/02602, WO 96/34096, WO 98/24893, WO 00/76310, and WO 03/47336.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more VH genes, one or more DH genes, one or more JH genes, a mu constant region, and a second constant region (preferably a gamma constant region) are formed into a construct for insertion into an animal. This approach is described in U.S. Pat. No. 5,545,807 to Surani et al. and U.S. Pat. Nos. 5,545,806, 5,625,825, 5,625,126, 5,633,425, 5,661,016, 5,770,429, 5,789,650, 5,814,318, 5,877,397, 5,874,299, and 6,255,458 each to Lonberg and Kay, U.S. Pat. Nos. 5,591,669 and 6,023,010 to Krimpenfort and Berns, U.S. Pat. Nos. 5,612,205, 5,721,367, and 5,789,215 to Berns et al., and U.S. Pat. No. 5,643,763 to Choi and Dunn, and GenPharm International U.S. patent application Ser. Nos. 07/574,748, 07/575,962, 07/810,279, 07/853,408, 07/904,068, 07/990,860, 08/053,131, 08/096,762, 08/155,301, 08/161,739, 08/165,699, 08/209,741. See also EP 0 546 073 B1, WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175. See further Taylor et al. (1992), Chen et al. (1993), Tuaillon et al. (1993), Choi et al. (1993), Lonberg et al. (1994), Taylor et al. (1994), and Tuaillon et al. (1995), Fishwild et al. (1996).

Kirin has also demonstrated the generation of human antibodies from mice in which, through microcell fusion, large pieces of chromosomes, or entire chromosomes, have been introduced. See European Patent Application Nos. 773 288 and 843 961. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996; 5,698,767; and 5,958,765.

Human anti-mouse antibody (HAMA) responses have led the industry to prepare chimeric or otherwise humanized antibodies. It is however expected that certain human anti-chimeric antibody (HACA) responses will be observed, particularly in chronic or multi-dose utilizations of the antibody. Thus, it would be desirable to provide antibody constructs comprising a fully human binding domain against the target cell surface antigen and a fully human binding domain against CD3 in order to vitiate concerns and/or effects of HAMA or HACA response.

The terms "(specifically) binds to", (specifically) recognizes", "is (specifically) directed to", and "(specifically) reacts with" mean in accordance with this invention that a binding domain interacts or specifically interacts with one or more, preferably at least two, more preferably at least three and most preferably at least four amino acids of an epitope located on the target protein or antigen (the target cell surface antigen/CD3).

The term "epitope" refers to a site on an antigen to which a binding domain, such as an antibody or immunoglobulin or derivative or fragment of an antibody or of an immunoglobulin, specifically binds. An "epitope" is antigenic and thus the term epitope is sometimes also referred to herein as "antigenic structure" or "antigenic determinant". Thus, the binding domain is an "antigen interaction site". Said binding/interaction is also understood to define a "specific recognition".

"Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigen for one of the binding domains is comprised within the target cell surface antigen protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy.

The interaction between the binding domain and the epitope or epitope cluster implies that a binding domain exhibits appreciable affinity for the epitope or epitope cluster on a particular protein or antigen (here: the target cell surface antigen and CD3, respectively) and, generally, does not exhibit significant reactivity with proteins or antigens other than the target cell surface antigen or CD3. "Appreciable affinity" includes binding with an affinity of about $10^{-6}$ M (KD) or stronger. Preferably, binding is considered specific when the binding affinity is about $10^{-12}$ to $10^{-8}$ M, $10^{-12}$ to $10^{-9}$ M, $10^{-12}$ to $10^{-10}$ M, $10^{-11}$ to $10^{-8}$ M, preferably of about $10^{-11}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than the target cell surface antigen or CD3. Preferably, a binding domain of the invention does not essentially or substantially bind to proteins or antigens other than the target cell surface antigen or CD3 (i.e., the first binding domain is not capable of binding to proteins other than the target cell surface antigen and the second binding domain is not capable of binding to proteins other than CD3).

The term "does not essentially/substantially bind" or "is not capable of binding" means that a binding domain of the present invention does not bind a protein or antigen other than the target cell surface antigen or CD3, i.e., does not show reactivity of more than 30%, preferably not more than 20%, more preferably not more than 10%, particularly preferably not more than 9%, 8%, 7%, 6% or 5% with proteins or antigens other than the target cell surface antigen or CD3, whereby binding to the target cell surface antigen or CD3, respectively, is set to be 100%.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-site with its specific antigen may result in a simple binding of said site to the antigen. Moreover, the specific interaction of the antigen-interaction-site with its specific antigen may alternatively or additionally result in the initiation of a signal, e.g. due to the induction of a change of the conformation of the antigen, an oligomerization of the antigen, etc.

The term "variable" refers to the portions of the antibody or immunoglobulin domains that exhibit variability in their sequence and that are involved in determining the specificity and binding affinity of a particular antibody (i.e., the "variable domain(s)"). The pairing of a variable heavy chain (VH) and a variable light chain (VL) together forms a single antigen-binding site. The CH domain most proximal to VH is designated as CH1. Each light (L) chain is linked to a heavy (H) chain by one covalent disulfide bond, while the two H chains are linked to each other by one or more disulfide bonds depending on the H chain isotype.

Variability is not evenly distributed throughout the variable domains of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM) and provide a scaffold for the six CDRs in three dimensional space to form an antigen-binding surface. The variable domains of naturally occurring heavy and light chains each comprise four FRM regions (FR1, FR2, FR3, and FR4), largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding site (see Kabat et al., loc. cit.). The constant domains are not directly involved in antigen binding, but exhibit various effector functions, such as, for example, antibody-dependent, cell-mediated cytotoxicity and complement activation.

The terms "CDR", and its plural "CDRs", refer to the complementarity determining region of which three make up the binding character of a light chain variable region (CDR-L1, CDR-L2 and CDR-L3) and three make up the binding character of a heavy chain variable region (CDR-H1, CDR-H2 and CDR-H3). CDRs contain most of the residues responsible for specific interactions of the antibody with the antigen and hence contribute to the functional activity of an antibody molecule: they are the main determinants of antigen specificity.

The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat (an approach based on cross-species sequence variability), Chothia (an approach based on crystallographic studies of antigen-antibody complexes), and/or MacCallum (Kabat et al., loc. cit.; Chothia et al., J. Mol. Biol, 1987, 196: 901-917; and MacCallum et al., J. Mol. Biol, 1996, 262: 732). Still another standard for characterizing the antigen binding site is the AbM definition used by Oxford Molecular's AbM antibody modeling software. See, e.g., Protein Sequence and Structure Analysis of Antibody Variable Domains. In: Antibody Engineering Lab Manual (Ed.: Duebel, S. and Kontermann, R., Springer-Verlag, Heidelberg). To the extent that two residue identification techniques define regions of overlapping, but not identical regions, they can be combined to define a hybrid CDR. However, the numbering in accordance with the so-called Kabat system is preferred.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al and/or revealed by other techniques, for example, crystallography and two- or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988.

The CDR3 of the light chain and, particularly, the CDR3 of the heavy chain may constitute the most important determinants in antigen binding within the light and heavy chain variable regions. In some antibody constructs, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen. Hence, CDR3 is typically the greatest source of molecular diversity within the antibody-binding site. H3, for example, can be as short as two amino acid residues or greater than 26 amino acids.

The sequence of antibody genes after assembly and somatic mutation is highly varied, and these varied genes are estimated to encode $10^{10}$ different antibody molecules (Immunoglobulin Genes, $2n^d$ ed., eds. Jonio et al., Academic Press, San Diego, Calif., 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

The term "bispecific" as used herein refers to an antibody construct which is "at least bispecific", i.e., it comprises at least a first binding domain and a second binding domain, wherein the first binding domain binds to one antigen or target, and the second binding domain binds to another antigen or target (here: CD3). Accordingly, antibody constructs according to the invention comprise specificities for at least two different antigens or targets. The term "bispecific antibody construct" of the invention also encompasses multispecific antibody constructs such as trispecific antibody constructs, the latter ones including three binding domains, or constructs having more than three (e.g. four, five . . . ) specificities.

Given that the antibody constructs according to the invention are (at least) bispecific, they do not occur naturally and they are markedly different from naturally occurring products. A "bispecific" antibody construct or immunoglobulin is hence an artificial hybrid antibody or immunoglobulin having at least two distinct binding sites with different specificities. Bispecific antibodies can be produced by a variety of methods including fusion of hybridomas or linking of Fab' fragments. See, e.g., Songsivilai & Lachmann, Clin. Exp. Immunol. 79:315-321 (1990).

The at least two binding domains and the variable domains of the antibody construct of the present invention may or may not comprise peptide linkers (spacer peptides). The term "peptide linker" defines in accordance with the present invention an amino acid sequence by which the amino acid sequences of one (variable and/or binding) domain and another (variable and/or binding) domain of the antibody construct of the invention are linked with each other. An essential technical feature of such peptide linker is that said peptide linker does not comprise any polymerization activity. Among the suitable peptide linkers are those described in U.S. Pat. Nos. 4,751,180 and 4,935,233 or WO 88/09344.

In the event that a linker is used, this linker is preferably of a length and sequence sufficient to ensure that each of the first and second domains can, independently from one another, retain their differential binding specificities. For peptide linkers which connect the at least two binding domains in the antibody construct of the invention (or two variable domains), those peptide linkers are preferred which comprise only a few number of amino acid residues, e.g. 12 amino acid residues or less. Thus, peptide linker of 12, 11, 10, 9, 8, 7, 6 or 5 amino acid residues are preferred. An envisaged peptide linker with less than 5 amino acids comprises 4, 3, 2 or one amino acid(s) wherein Gly-rich linkers are preferred. A particularly preferred "single" amino acid in context of said "peptide linker" is Gly. Accordingly, said peptide linker may consist of the single amino acid Gly. Another preferred embodiment of a peptide linker is characterized by the amino acid sequence Gly-Gly-Gly-Gly-Ser, i.e. Gly$_4$Ser, or polymers thereof, i.e. (Gly$_4$Ser)x, where x is an integer of 1 or greater. The characteristics of said peptide linker, which comprise the absence of the promotion of secondary structures are known in the art and are described e.g. in Dall'Acqua et al. (Biochem. (1998) 37, 9266-9273), Cheadle et al. (Mol Immunol (1992) 29, 21-30) and Raag and Whitlow (FASEB (1995) 9(1), 73-80). Peptide linkers which also do not promote any secondary structures are preferred. The linkage of said domains to each other can be provided by, e.g. genetic engineering, as described in the examples. Methods for preparing fused and operatively linked bispecific single chain constructs and expressing them in mammalian cells or bacteria are well-known in the art (e.g. WO 99/54440 or Sambrook et al., Molecular Cloning: A Laboratory Manual, Cold Spring Harbor Laboratory Press, Cold Spring Harbor, New York, 2001).

Bispecific single chain molecules are known in the art and are described in WO 99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56. Techniques described for the production of single chain antibodies (see, inter alia, U.S. Pat. No. 4,946,778, Kontermann and Dübel (2010), loc. cit. and Little (2009), loc. cit.) can be adapted to produce single chain antibody constructs specifically recognizing (an) elected target(s).

Bivalent (also called divalent) or bispecific single-chain variable fragments (bi-scFvs or di-scFvs having the format $(scFv)_2$) can be engineered by linking two scFv molecules. If these two scFv molecules have the same binding specificity, the resulting $(scFv)_2$ molecule will preferably be called bivalent (i.e. it has two valences for the same target epitope). If the two scFv molecules have different binding specificities, the resulting $(scFv)_2$ molecule will preferably be called bispecific. The linking can be done by producing a single peptide chain with two VH regions and two VL regions, yielding tandem scFvs (see e.g. Kufer P. et al., (2004) Trends in Biotechnology 22(5):238-244). Another possibility is the creation of scFv molecules with linker peptides that are too short for the two variable regions to fold together (e.g. about five amino acids), forcing the scFvs to dimerize. This type is known as diabodies (see e.g. Hollinger, Philipp et al., (July 1993) Proceedings of the National Academy of Sciences of the United States of America 90 (14): 6444-8.).

Single domain antibodies comprise merely one (monomeric) antibody variable domain which is able to bind selectively to a specific antigen, independently of other V regions or domains. The first single domain antibodies were engineered from heavy chain antibodies found in camelids, and these are called $V_HH$ fragments. Cartilaginous fishes also have heavy chain antibodies (IgNAR) from which single domain antibodies called $V_{NAR}$ fragments can be obtained. An alternative approach is to split the dimeric variable domains from common immunoglobulins e.g. from humans or rodents into monomers, hence obtaining VH or VL as a single domain Ab. Although most research into single domain antibodies is currently based on heavy chain variable domains, nanobodies derived from light chains have also been shown to bind specifically to target epitopes. Examples of single domain antibodies are called sdAb, nanobodies or single variable domain antibodies.

A (single domain mAb)$_2$ is hence a monoclonal antibody construct composed of (at least) two single domain monoclonal antibodies, which are individually selected from the group comprising VH, VL, $V_HH$ and $V_{NAR}$. The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

Bispecific single chain molecules are known in the art and are described in WO 99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56. Techniques described for the production of single chain antibodies (see, inter alia, U.S. Pat. No. 4,946,778, Kontermann and Dübel (2010), loc. cit. and Little (2009), loc. cit.) can be adapted to produce single chain antibody constructs specifically recognizing (an) elected target(s).

Bivalent (also called divalent) or bispecific single-chain variable fragments (bi-scFvs or di-scFvs having the format $(scFv)_2$) can be engineered by linking two scFv molecules. If these two scFv molecules have the same binding specificity, the resulting $(scFv)_2$ molecule will preferably be called bivalent (i.e. it has two valences for the same target epitope). If the two scFv molecules have different binding specificities, the resulting $(scFv)_2$ molecule will preferably be called bispecific. The linking can be done by producing a single peptide chain with two VH regions and two VL regions, yielding tandem scFvs (see e.g. Kufer P. et al., (2004) Trends in Biotechnology 22(5):238-244). Another possibility is the creation of scFv molecules with linker peptides that are too short for the two variable regions to fold together (e.g. about five amino acids), forcing the scFvs to dimerize. This type is known as diabodies (see e.g. Hollinger, Philipp et al., (July 1993) Proceedings of the National Academy of Sciences of the United States of America 90 (14): 6444-8.).

Single domain antibodies comprise merely one (monomeric) antibody variable domain which is able to bind selectively to a specific antigen, independently of other V regions or domains. The first single domain antibodies were engineered from heavy chain antibodies found in camelids, and these are called $V_HH$ fragments. Cartilaginous fishes also have heavy chain antibodies (IgNAR) from which single domain antibodies called $V_{NAR}$ fragments can be obtained. An alternative approach is to split the dimeric variable domains from common immunoglobulins e.g. from humans or rodents into monomers, hence obtaining VH or VL as a single domain Ab. Although most research into single domain antibodies is currently based on heavy chain variable domains, nanobodies derived from light chains have also been shown to bind specifically to target epitopes. Examples of single domain antibodies are called sdAb, nanobodies or single variable domain antibodies.

A (single domain mAb)$_2$ is hence a monoclonal antibody construct composed of (at least) two single domain monoclonal antibodies, which are individually selected from the group comprising VH, VL, $V_HH$ and $V_{NAR}$. The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

It is also envisaged that the antibody construct of the invention has, in addition to its function to bind to the target antigen and CD3, a further function. In this format, the antibody construct is a trifunctional or multifunctional antibody construct by targeting target cells through binding to the target antigen, mediating cytotoxic T cell activity through CD3 binding and providing a further function such as a label (fluorescent etc.), a therapeutic agent such as a toxin or radionuclide, etc.

Covalent modifications of the antibody constructs are also included within the scope of this invention, and are generally, but not always, done post-translationally. For example, several types of covalent modifications of the antibody construct are introduced into the molecule by reacting specific amino acid residues of the antibody construct with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0. Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using $^{125}I$ or $^{131}I$ to prepare labeled proteins for use in radioimmunoassay, the chloramine T method described above being suitable.

Carboxyl side groups (aspartyl or glutamyl) are selectively modified by reaction with carbodiimides (R'—N═C═N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for cross-linking the antibody constructs of the present invention to a water-insoluble support matrix or surface for use in a variety of methods. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates described in U.S. Pat. Nos. 3,969,287; 3,691,016; 4,195,128; 4,247,642; 4,229,537; and 4,330,440 are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

Another type of covalent modification of the antibody constructs included within the scope of this invention comprises altering the glycosylation pattern of the protein. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody construct is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the amino acid sequence of an antibody construct is preferably altered through changes at the DNA level, particularly by mutating the DNA encoding the polypeptide at preselected bases such that codons are generated that will translate into the desired amino acids.

Another means of increasing the number of carbohydrate moieties on the antibody construct is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330, and in Aplin and Wriston, 1981, CRC Crit. Rev. Biochem., pp. 259-306.

Removal of carbohydrate moieties present on the starting antibody construct may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, *Arch. Biochem. Biophys.* 259:52 and by Edge et al., 1981, *Anal. Biochem.* 118:131. Enzymatic cleavage of carbohydrate moieties on polypeptides can be achieved by the use of a variety of endo- and exo-glycosidases as described by Thotakura et al., 1987, Meth. Enzymol. 138:350. Glycosylation at potential glycosylation sites may be prevented by the use of the compound tunicamycin as described by Duskin et al., 1982, J. Biol. Chem. 257:3105. Tunicamycin blocks the formation of protein-N-glycoside linkages.

Other modifications of the antibody construct are contemplated herein. For example, another type of covalent modification of the antibody construct comprises linking the antibody construct to various non-proteinaceous polymers, including, but not limited to, various polyols such as polyethylene glycol, polypropylene glycol, polyoxyalkylenes, or copolymers of polyethylene glycol and polypropylene glycol, in the manner set forth in U.S. Pat. Nos. 4,640,835; 4,496,689; 4,301,144; 4,670,417; 4,791,192 or 4,179,337. In addition, as is known in the art, amino acid substitutions may be made in various positions within the antibody construct, e.g. in order to facilitate the addition of polymers such as PEG.

In some embodiments, the covalent modification of the antibody constructs of the invention comprises the addition of one or more labels. The labelling group may be coupled to the antibody construct via spacer arms of various lengths to reduce potential steric hindrance. Various methods for labelling proteins are known in the art and can be used in performing the present invention. The term "label" or "labelling group" refers to any detectable label. In general, labels fall into a variety of classes, depending on the assay in which they are to be detected—the following examples include, but are not limited to:
 a) isotopic labels, which may be radioactive or heavy isotopes, such as radioisotopes or radionuclides (e.g., $^{3}H$, $^{14}C$, $^{15}N$, $^{35}S$, $^{89}Z$, $^{90}Y$, $^{99}Tc$, $^{111}In$, $^{125}I$, $^{131}I$)
 b) magnetic labels (e.g., magnetic particles)
 c) redox active moieties
 d) optical dye (including, but not limited to, chromophores, phosphors and fluorophores) such as fluorescent groups (e.g., FITC, rhodamine, lanthanide phosphors), chemiluminescent groups, and fluorophores which can be either "small molecule" fluores or proteinaceous fluores
 e) enzymatic groups (e.g. horseradish peroxidase, β-galactosidase, luciferase, alkaline phosphatase)
 f) biotinylated groups
 g) predetermined polypeptide epitopes recognized by a secondary reporter (e.g., leucine zipper pair sequences, binding sites for secondary antibodies, metal binding domains, epitope tags, etc.)

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, Oreg.), FITC, Rhodamine, and Texas Red (Pierce, Rockford, Ill.), Cy5, Cy5.5, Cy7 (Amersham Life Science, Pittsburgh, Pa.). Suitable optical dyes, including fluorophores, are described in Molecular Probes Handbook by Richard P. Haugland.

Suitable proteinaceous fluorescent labels also include, but are not limited to, green fluorescent protein, including a Renilla, Ptilosarcus, or Aequorea species of GFP (Chalfie et al., 1994, *Science* 263:802-805), EGFP (Clontech Laboratories, Inc., Genbank Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, *Biotechniques* 24:462-471; Heim et al., 1996, *Curr. Biol.* 6:178-182), enhanced yellow fluorescent protein (EYFP, Clontech Laboratories, Inc.), luciferase (Ichiki et al., 1993, *J. Immunol.* 150:5408-5417), β galactosidase (Nolan et al., 1988, *Proc. Natl. Acad. Sci. U.S.A.* 85:2603-2607) and Renilla (WO92/15673, WO95/07463, WO98/14605, WO98/26277, WO99/49019, U.S. Pat. Nos. 5,292,658, 5,418,155, 5,683,888, 5,741,668, 5,777,079, 5,804,387, 5,874,304, 5,876,995, 5,925,558).

Leucine zipper domains are peptides that promote oligomerization of the proteins in which they are found. Leucine zippers were originally identified in several DNA-binding proteins (Landschulz et al., 1988, *Science* 240:1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, *FEBS Letters* 344:191. The use of a modified leucine zipper that allows for stable trimerization of a heterologous protein fused thereto is described in Fanslow et al., 1994, *Semin. Immunol.* 6:267-78. In one approach, recombinant fusion proteins comprising the target antigen antibody fragment or derivative fused to a leucine zipper peptide are expressed in suitable host cells, and the soluble oligomeric target antigen antibody fragments or derivatives that form are recovered from the culture supernatant.

The antibody construct of the invention may also comprise additional domains, which are e.g. helpful in the isolation of the molecule or relate to an adapted pharmacokinetic profile of the molecule. Domains helpful for the isolation of an antibody construct may be selected from peptide motives or secondarily introduced moieties, which can be captured in an isolation method, e.g. an isolation column. Non-limiting embodiments of such additional domains comprise peptide motives known as Myc-tag, HAT-tag, HA-tag, TAP-tag, GST-tag, chitin binding domain (CBD-tag), maltose binding protein (MBP-tag), Flag-tag, Strep-tag and variants thereof (e.g. StrepII-tag) and His-tag. All herein disclosed antibody constructs characterized by the identified CDRs are preferred to comprise a His-tag domain, which is generally known as a repeat of consecutive His residues in the amino acid sequence of a molecule, preferably of six His residues.

T cells or T lymphocytes are a type of lymphocyte (itself a type of white blood cell) that play a central role in cell-mediated immunity. There are several subsets of T cells, each with a distinct function. T cells can be distinguished from other lymphocytes, such as B cells and NK cells, by the presence of a T cell receptor (TCR) on the cell surface. The TCR is responsible for recognizing antigens bound to major histocompatibility complex (MHC) molecules and is composed of two different protein chains. In 95% of the T cells, the TCR consists of an alpha (α) and beta (β) chain. When the TCR engages with antigenic peptide and MHC (peptide/MHC complex), the T lymphocyte is activated through a series of biochemical events mediated by associated enzymes, co-receptors, specialized adaptor molecules, and activated or released transcription factors The CD3 receptor complex is a protein complex and is composed of four chains. In mammals, the complex contains a CD3γ (gamma) chain, a CD3δ (delta) chain, and two CD3ε (epsilon) chains. These chains associate with the T cell receptor (TCR) and the so-called ζ (zeta) chain to form the T cell receptor CD3 complex and to generate an activation signal in T lymphocytes. The CD3γ (gamma), CD3δ (delta), and CD3ε (epsilon) chains are highly related cell-surface proteins of the immunoglobulin superfamily containing a single extracellular immunoglobulin domain. The intracellular tails of the CD3 molecules contain a single conserved motif known as an immunoreceptor tyrosine-based activation motif or ITAM for short, which is essential for the signaling capacity of the TCR. The CD3 epsilon molecule is a polypeptide which in humans is encoded by the CD3E gene which resides on chromosome 11. The sequence of a preferred human CD3 epsilon extracellular domain is shown in SEQ ID NO: 605, and the most preferred CD3 binding epitope corresponding to amino acid residues 1-27 of the human CD3 epsilon extracellular domain is represented in SEQ ID NO: 604.

The redirected lysis of target cells via the recruitment of T cells by a multispecific, at least bispecific, antibody construct involves cytolytic synapse formation and delivery of perforin and granzymes. The engaged T cells are capable of serial target cell lysis, and are not affected by immune escape mechanisms interfering with peptide antigen processing and presentation, or clonal T cell differentiation; see, for example, WO 2007/042261.

Cytotoxicity mediated by bispecific antibody constructs can be measured in various ways. Effector cells can be e.g. stimulated enriched (human) CD8 positive T cells or unstimulated (human) peripheral blood mononuclear cells (PBMC). If the target cells are of macaque origin or express or are transfected with macaque target cell antigen, the effector cells should also be of macaque origin such as a macaque T cell line, e.g. 4119LnPx. The target cells should express (at least the extracellular domain of) target cell antigen, e.g. human or macaque target cell antigen. Target cells can be a cell line (such as CHO) which is stably or transiently transfected with target cell antigen, e.g. human or macaque target cell antigen. Alternatively, the target cells can be a target cell antigen positive natural expresser cell line, such as a human cancer cell line. Usually EC50 values are expected to be lower with target cell lines expressing higher levels of target cell antigen on the cell surface. The effector to target cell (E:T) ratio is usually about 10:1, but can also vary. Cytotoxic activity of bispecific antibody constructs can be measured in a $^{51}$chromium release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by bispecific antibody constructs of the present invention is preferably measured in a cell-based cytotoxicity assay. It is represented by the $EC_{50}$ value, which corresponds to the half maximal effective concentration (concentration of the antibody construct which induces a cytotoxic response halfway between the baseline and maximum). Preferably, the $EC_{50}$ value of the bispecific antibody constructs is ≤20,000 pg/ml, more preferably ≤5000 pg/ml, even more preferably ≤1000 pg/ml, even more preferably 5500 pg/ml, even more preferably ≤350 pg/ml, even more preferably ≤250 pg/ml, even more preferably ≤100 pg/ml, even more preferably ≤50 pg/ml, even more preferably ≤10 pg/ml, and most preferably ≤5 pg/ml.

Any of the above given $EC_{50}$ values can be combined with any one of the indicated scenarios of a cell-based cytotoxicity assay, e.g. in line with the methods described in the appended example. For example, when (human) CD8 positive T cells or a macaque T cell line are used as effector cells, the $EC_{50}$ value of the bispecific antibody construct of the invention (e.g. a target cell antigen/CD3 bispecific construct) is preferably ≤1000 pg/ml, more preferably ≤500 pg/ml, even more preferably ≤250 pg/ml, even more preferably ≤100 pg/ml, even more preferably ≤50 pg/ml, even more preferably ≤10 pg/ml, and most preferably ≤5 pg/ml. If in this assay the target cells are (human or macaque) cells transfected with the target antigen (e.g. target cell antigen), such as CHO cells, the $EC_{50}$ value of the bispecific antibody construct is preferably ≤150 pg/ml, more preferably ≤100 pg/ml, even more preferably 550 pg/ml, even more preferably ≤30 pg/ml, even more preferably ≤10 pg/ml, and most preferably ≤5 pg/ml. If the target cells are a positive natural expresser cell line (e.g. of target cell antigen), then the $EC_{50}$ value is preferably ≤350 pg/ml, more preferably ≤250 pg/ml, even more preferably ≤200 pg/ml, even more preferably ≤100 pg/ml, even more preferably ≤150 pg/ml, even more preferably ≤100 pg/ml, and most preferably ≤50 pg/ml, or lower. When (human) PBMCs are used as effector cells, the $EC_{50}$ value of the bispecific antibody construct is preferably ≤1000 pg/ml, more preferably ≤750 pg/ml, more preferably ≤500 pg/ml, even more preferably ≤350 pg/ml, even more preferably ≤250 pg/ml, even more preferably ≤100 pg/ml, and most preferably ≤50 pg/ml, or lower.

Preferably, the bispecific antibody constructs of the present invention do not induce/mediate lysis or do not essentially induce/mediate lysis of target cell antigen negative cells such as CHO cells. The term "do not induce lysis", "do not essentially induce lysis", "do not mediate lysis" or "do not essentially mediate lysis" means that an antibody constructs of the present invention does not induce or mediate lysis of more than 30%, preferably not more than 20%, more preferably not more than 10%, particularly preferably not more than 9%, 8%, 7%, 6% or 5% of target cell antigen negative cells, whereby lysis of a target cell antigen positive cell line is set to be 100%. This usually applies for concentrations of the antibody construct of up to 500 nM. The skilled person knows how to measure cell lysis without further ado. Moreover, the present specification teaches specific instructions how to measure cell lysis.

The difference in cytotoxic activity between the monomeric and the dimeric isoform of individual bispecific antibody constructs is referred to as "potency gap". This potency gap can e.g. be calculated as ratio between $EC_{50}$ values of the molecule's monomeric and dimeric form. Potency gaps of the bispecific antibody constructs of the present invention are preferably ≤5, more preferably ≤4, even more preferably ≤3, even more preferably ≤2 and most preferably ≤1.

As well as the second binding domain the first (or any further) binding domain(s) of the antibody construct of the invention is/are preferably cross-species specific for members of the mammalian order of primates. Cross-species specific CD3 binding domains are, for example, described in WO 2008/119567. According to one embodiment, the first and second binding domain, in addition to binding to human target cell antigen and human CD3, respectively, will also bind to the target cell antigen/CD3 of primates including (but not limited to) new world primates (such as *Callithrix jacchus, Saguinus Oedipus* or *Saimiri sciureus*), old world primates (such baboons and macaques), gibbons, and non-human homininae.

In one aspect of the invention, the first binding domain binds to human CDH19 (SEQ ID NO: 606) and further binds to macaque CDH19, such as CDH19 of *Macaca fascicularis* (SEQ ID NO: 607). The affinity of the first binding domain for macaque CDH19 is preferably 515 nM, more preferably ≤10 nM, even more preferably ≤5 nM, even more preferably ≤1 nM, even more preferably ≤0.5 nM, even more preferably ≤0.1 nM, and most preferably ≤0.05 nM or even ≤0.01 nM.

Preferably the affinity gap of the antibody constructs according to the invention for binding to its macaque vs human target antigen, e.g. macaque CDH19 versus human CDH19 [maCDH19:huCDH19] is between 0.1 and 10, more preferably between 0.2 and 5, even more preferably between 0.3 and 2.5, even more preferably between 0.4 and 2, and most preferably between 0.5 and 1.

In one embodiment the invention provides a bispecific single chain antibody construct, wherein serum albumin is a human serum albumin or an FcRn binding optimized variant thereof. Variants of human albumin are described e.g. in WO 2014/072481.

In one embodiment of the antibody construct of the invention, the serum albumin comprises an amino acid sequence selected from the group consisting of SEQ ID NOs: 4 to 12 and 608 to 628.

Also in one embodiment of the antibody construct of the invention, the serum albumin is linked to the antibody construct via a peptide linker. It is preferred that the peptide linker has the amino acid sequence (GGGGS)$_n$ (SEQ ID NO: 13)$_n$, (PGGGGS)$_n$ (SEQ ID NO: 2707)$_n$, or (PGGDGS)$_n$ (SEQ ID NO: 2708)$_n$, wherein "n" is an integer in the range of 1 to 5. Further preferred is that "n" is an integer in the range of 1 to 3, and most preferably "n" is 1 or 2.

In one embodiment of the antibody construct of the invention the second binding domain comprises a VL region having CDR-L1-L3 and a VH region having CDR-H1-H3 selected from the group consisting of:
 (a) CDR-L1-L3 as depicted in SEQ ID NOs:14-16 and CDR-H1-H3 as depicted in SEQ ID NOs:17-19;
 (b) CDR-L1-L3 as depicted in SEQ ID NOs:26-28 and CDR-H1-H3 as depicted in SEQ ID NOs:29-31;
 (c) CDR-L1-L3 as depicted in SEQ ID NOs:38-40 and CDR-H1-H3 as depicted in SEQ ID NOs:41-43;
 (d) CDR-L1-L3 as depicted in SEQ ID NOs:50-52 and CDR-H1-H3 as depicted in SEQ ID NOs:53-55;
 (e) CDR-L1-L3 as depicted in SEQ ID NOs:62-64 and CDR-H1-H3 as depicted in SEQ ID NOs:65-67;
 (f) CDR-L1-L3 as depicted in SEQ ID NOs:74-76 and CDR-H1-H3 as depicted in SEQ ID NOs:77-79;
 (g) CDR-L1-L3 as depicted in SEQ ID NOs:86-88 and CDR-H1-H3 as depicted in SEQ ID NOs:89-91;
 (h) CDR-L1-L3 as depicted in SEQ ID NOs:98-100 and CDR-H1-H3 as depicted in SEQ ID NOs:101-103;
 (i) CDR-L1-L3 as depicted in SEQ ID NOs:110-112 and CDR-H1-H3 as depicted in SEQ ID NOs:113-115; and
 (j) CDR-L1-L3 as depicted in SEQ ID NOs:122-124 and CDR-H1-H3 as depicted in SEQ ID NOs:125-127.

In one embodiment of the antibody construct of the invention the second binding domain comprises pairs of VH and VL chains selected from the group consisting of:
 (a) a VH-chain as depicted in SEQ ID NO: 20 and a VL-chain as depicted in SEQ ID NO: 22;
 (b) a VH-chain as depicted in SEQ ID NO: 32 and a VL-chain as depicted in SEQ ID NO: 34;
 (c) a VH-chain as depicted in SEQ ID NO: 44 and a VL-chain as depicted in SEQ ID NO: 46;
 (d) a VH-chain as depicted in SEQ ID NO: 56 and a VL-chain as depicted in SEQ ID NO: 58;
 (e) a VH-chain as depicted in SEQ ID NO: 68 and a VL-chain as depicted in SEQ ID NO: 70;
 (f) a VH-chain as depicted in SEQ ID NO: 80 and a VL-chain as depicted in SEQ ID NO: 82;
 (g) a VH-chain as depicted in SEQ ID NO: 92 and a VL-chain as depicted in SEQ ID NO: 94;
 (h) a VH-chain as depicted in SEQ ID NO: 104 and a VL-chain as depicted in SEQ ID NO: 106;
 (i) a VH-chain as depicted in SEQ ID NO: 116 and a VL-chain as depicted in SEQ ID NO: 118; and
 (j) a VH-chain as depicted in SEQ ID NO: 128 and a VL-chain as depicted in SEQ ID NO: 130.

Also in one embodiment of the antibody construct of the invention the second binding domain comprises an amino acid sequence as depicted in SEQ ID NO: 24, SEQ ID NO: 36, SEQ ID NO: 48, SEQ ID NO: 60, SEQ ID NO: 72, SEQ ID NO: 84, SEQ ID NO: 96, SEQ ID NO: 108, SEQ ID NO: 120 or SEQ ID NO: 132.

In a further embodiment of the antibody construct of the invention, the first binding domain binds to a target cell surface antigen, which is a tumor antigen or a viral antigen on the surface of an infected host cell. In a preferred embodiment the tumor antigen is selected from the group consisting of CDH19, MSLN, DLL3, FLT3, EGFRvIII, CD33, CD19, CD20, and CD70. Preferred viral antigens are selected from a group consisting of Influenza A, CMV and HIV.

The invention further provides an antibody construct, wherein the antibody construct comprises an amino acid sequences selected from the group consisting of:
 (a) SEQ ID NOs: 134-180;
 (b) SEQ ID NOs: 181-227;
 (c) SEQ ID NOs: 228-274;
 (d) SEQ ID NOs: 275-321;
 (e) SEQ ID NOs: 322-368;
 (f) SEQ ID NOs: 369-415;
 (g) SEQ ID NOs: 416-462;
 (h) SEQ ID NOs: 463-509;
 (i) SEQ ID NOs: 510-556; and
 (j) SEQ ID NOs: 557-603.

The invention also provides an antibody construct, wherein the antibody construct comprises the following elements starting from the N-terminus:
 (a) an scFv binding to the target cell surface antigen having an amino acid sequence selected from the group consisting of SEQ ID NOs: 629-675, 684, 694, 704, 714, 724, 734, 744, 754, 764, 774, 784, 794, 804, 814, 824, 834, 844, 854, 864, 874, 884, 894, 904, 914, 924, 934, 944, 954, 964, 974, 984, 994, 1004, 1014, 1024, 1034, 1044, 1054, 1064, 1074, 1084, 1094, 1104, 1114, 1124, 1134, 1144, 1154, 1164, 1174, 1184, 1194, 1204, 1214, 1224, 1234, 1244, 1254, 1264, 1274, 1284, 1294, 1304, 1314, 1324, 1334, 1344, 1354, 1364, 1374, 1384, 1394, 1404, 1414, 1424, 1434, 1444, 1454, 1464, 1474, 1484, 1494, 1504, 1514, 1524, 1534, 1544, 1554, 1564, 1574, 1584, 1594, 1604, 1614, 1624, 1634, 1644, 1654, 1664, 1674, 1684, 1694, 1704, 1714, 1724, 1734, 1744, 1754, 1764, 1774, 1784, 1794, 1804, 1814, 1824, 1834, 1844, 1854, 1864, 1874, 1884, 1894, 1904, 1914, 1924, 1934, 1944, 1954, 1964, 1974, 2004, 2014, 2024, 2034, 2044, 2054, 2064, 2074, 2084, 2094, 2104, 2114, 2124, 2134, 2144, 2154, 2164, 2174, 2184, 2194, 2204, 2214, 2224, 2234, 2244, 2254, 2264, 2274, 2284, 2294, 2304, 2314, 2324, 2334, 2344, 2354, 2364, 2374, 2384, 2394, 2404, 2414, 2424, 2434, 2444, 2454, 2464, 2474, 2484, 2494, 2504, 2514, 2524, 2534, 2544, 2554, 2564, 2574, 2584, 2594, 2604, 2614, 2624, 2634, 2644, 2654, 2664, 2674, 2684, 2694, and 2704;
(b) a peptide linker having an amino acid sequence selected from the group consisting of SEQ ID NOs: 13 and 2707-2709;
(c) an scFv binding to the T cell surface antigen CD3 having an amino acid sequence selected from the group consisting of SEQ ID NOs: 24, 36, 48, 60, 72, 84, 96, 108, 120, 132 and 2706;
(d) a peptide linker having an amino acid sequence selected from the group consisting of SEQ ID NOs: 13 and 2707-2709;
(e) a serum albumin having an amino acid sequence selected from the group consisting of SEQ ID NOs: 4 to 12 and 608 to 628; and
(f) optionally a His-tag.

It is particularly preferred that the elements defined in above items (a) to (f) are arranged in this sequence from the N-terminus to the C-terminus of the antibody construct.

Amino acid sequence modifications of the antibody constructs described herein are also contemplated. For example, it may be desirable to improve the binding affinity and/or other biological properties of the antibody construct. Amino acid sequence variants of the antibody constructs are prepared by introducing appropriate nucleotide changes into the antibody constructs nucleic acid, or by peptide synthesis. All of the below described amino acid sequence modifications should result in an antibody construct which still retains the desired biological activity (binding to target cell antigen and to CD3) of the unmodified parental molecule.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (He or I): leucine (Leu or L); lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, He, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gln, Gly, His, Met, Phe, Ser, Thr, Trp, and Tyr).

Amino acid modifications include, for example, deletions from, and/or insertions into, and/or substitutions of, residues within the amino acid sequences of the antibody constructs. Any combination of deletion, insertion, and substitution is made to arrive at the final construct, provided that the final construct possesses the desired characteristics. The amino acid changes also may alter post-translational processes of the antibody constructs, such as changing the number or position of glycosylation sites.

For example, 1, 2, 3, 4, 5, or 6 amino acids may be inserted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted or deleted in each of the FRs. Preferably, amino acid sequence insertions include amino- and/or carboxyl-terminal fusions ranging in length from 1, 2, 3, 4, 5, 6, 7, 8, 9 or 10 residues to polypeptides containing a hundred or more residues, as well as intra-sequence insertions of single or multiple amino acid residues. An insertional variant of the antibody construct of the invention includes the fusion to the N-terminus or to the C-terminus of the antibody construct to an enzyme or a fusion to a polypeptide which increases the serum half-life of the antibody construct.

The sites of greatest interest for substitutional mutagenesis include the CDRs of the heavy and/or light chain, in particular the hypervariable regions, but FR alterations in the heavy and/or light chain are also contemplated. The substitutions are preferably conservative substitutions as described herein. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs), depending on the length of the CDR or FR. For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

A useful method for identification of certain residues or regions of the antibody constructs that are preferred locations for mutagenesis is called "alanine scanning mutagenesis" as described by Cunningham and Wells in Science, 244: 1081-1085 (1989). Here, a residue or group of target residues within the antibody construct is/are identified (e.g. charged residues such as arg, asp, his, lys, and glu) and replaced by a neutral or negatively charged amino acid (most preferably alanine or polyalanine) to affect the interaction of the amino acids with the epitope.

Those amino acid locations demonstrating functional sensitivity to the substitutions then are refined by introducing further or other variants at, or for, the sites of substitution. Thus, while the site or region for introducing an amino acid sequence variation is predetermined, the nature of the mutation per se needs not to be predetermined. For example, to analyze or optimize the performance of a mutation at a given site, alanine scanning or random mutagenesis may be conducted at a target codon or region, and the expressed antibody construct variants are screened for the optimal combination of desired activity. Techniques for making substitution mutations at predetermined sites in the DNA having a known sequence are well known, for example, M13 primer mutagenesis and PCR mutagenesis. Screening of the mutants is done using assays of target antigen binding activities.

Generally, if amino acids are substituted in one or more or all of the CDRs of the heavy and/or light chain, it is preferred that the then-obtained "substituted" sequence is at least 60%, more preferably 65%, even more preferably 70%, particularly preferably 75%, more particularly preferably 80% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the antibody construct may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed in Table 1, below) is envisaged as long as the antibody construct retains its capability to bind to target cell antigen via the first binding domain and to CD3 epsilon via the second binding domain and/or its CDRs have an identity to the then substituted sequence (at least 60%, more preferably 65%, even more preferably 70%, particularly preferably 75%, more particularly preferably 80% identical to the "original" CDR sequence).

Conservative substitutions are shown in Table 1 under the heading of "preferred substitutions". If such substitutions result in a change in biological activity, then more substantial changes, denominated "exemplary substitutions" in Table A, or as further described below in reference to amino acid classes, may be introduced and the products screened for a desired characteristic.

TABLE A

Amino acid substitutions

| Original | Exemplary Substitutions | Preferred Substitutions |
|---|---|---|
| Ala (A) | val, leu, ile | val |
| Arg (R) | lys, gln, asn | lys |
| Asn (N) | gln, his, asp, lys, arg | gln |
| Asp (D) | glu, asn | glu |
| Cys (C) | ser, ala | ser |
| Gln (Q) | asn, glu | asn |
| Glu (E) | asp, gln | asp |
| Gly (G) | Ala | ala |
| His (H) | asn, gln, lys, arg | arg |
| Ile (I) | leu, val, met, ala, phe | leu |
| Leu (L) | norleucine, ile, val, met, ala | ile |
| Lys (K) | arg, gln, asn | arg |
| Met (M) | leu, phe, ile | leu |
| Phe (F) | leu, val, ile, ala, tyr | tyr |
| Pro (P) | Ala | ala |
| Ser (S) | Thr | thr |
| Thr (T) | Ser | ser |
| Trp (W) | tyr, phe | tyr |
| Tyr (Y) | trp, phe, thr, ser | phe |
| Val (V) | ile, leu, met, phe, ala | leu |

Substantial modifications in the biological properties of the antibody construct of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: cys, ser, thr; (3) acidic: asp, glu; (4) basic: asn, gln, his, lys, arg; (5) residues that influence chain orientation: gly, pro; and (6) aromatic: trp, tyr, phe.

Non-conservative substitutions will entail exchanging a member of one of these classes for another class. Any cysteine residue not involved in maintaining the proper conformation of the antibody construct may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

For amino acid sequences, sequence identity and/or similarity is determined by using standard techniques known in the art, including, but not limited to, the local sequence identity algorithm of Smith and Waterman, 1981, *Adv. Appl. Math.* 2:482, the sequence identity alignment algorithm of Needleman and Wunsch, 1970, *J. Mol. Biol.* 48:443, the search for similarity method of Pearson and Lipman, 1988, *Proc. Nat. Acad. Sci. U.S.A.* 85:2444, computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., 1984, *Nucl. Acid Res.* 12:387-395, preferably using the default settings, or by inspection. Preferably, percent identity is calculated by FastDB based upon the following parameters: mismatch penalty of 1; gap penalty of 1; gap size penalty of 0.33; and joining penalty of 30, "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, 1987, *J. Mol. Eva* 35:351-360; the method is similar to that described by Higgins and Sharp, 1989, *CABIOS* 5:151-153. Useful PILEUP parameters including a default gap weight of 3.00, a default gap length weight of 0.10, and weighted end gaps.

Another example of a useful algorithm is the BLAST algorithm, described in: Altschul et al., 1990, *J. Mol. Biol.* 215:403-410; Altschul et al., 1997, *Nucleic Acids Res.* 25:3389-3402; and Karin et al., 1993, *Proc. Natl. Acad. Sci. U.S.A.* 90:5873-5787. A particularly useful BLAST program is the WU-BLAST-2 program which was obtained from Altschul et al., 1996, *Methods in Enzymology* 266:460-480. WU-BLAST-2 uses several search parameters, most of which are set to the default values. The adjustable parameters are set with the following values: overlap span=1, overlap fraction=0.125, word threshold (T)=II. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al., 1993, *Nucl. Acids Res.* 25:3389-3402. Gapped BLAST uses BLOSUM-62 substitution scores; threshold T parameter set to 9; the two-hit method to trigger ungapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

Generally, the amino acid homology, similarity, or identity between individual variant CDRs are at least 60% to the sequences depicted herein, and more typically with preferably increasing homologies or identities of at least 65% or 70%, more preferably at least 75% or 80%, even more preferably at least 85%, 90%, 91%, 92%, 93%, 94%, 95%, 96%, 97%, 98%, 99%, and almost 100%. In a similar manner, "percent (%) nucleic acid sequence identity" with respect to the nucleic acid sequence of the binding proteins identified herein is defined as the percentage of nucleotide residues in a candidate sequence that are identical with the nucleotide residues in the coding sequence of the antibody construct. A specific method utilizes the BLASTN module of WU-BLAST-2 set to the default parameters, with overlap span and overlap fraction set to 1 and 0.125, respectively.

Generally, the nucleic acid sequence homology, similarity, or identity between the nucleotide sequences encoding individual variant CDRs and the nucleotide sequences depicted herein are at least 60%, and more typically with preferably increasing homologies or identities of at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99%, and almost 100%. Thus, a "variant CDR" is one with the specified homology, similarity, or identity to the parent CDR of the invention, and shares biological function, including, but not limited to, at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR.

It is furthermore envisaged that the bispecific antibody constructs of the present invention exhibit therapeutic efficacy or anti-tumor activity. This can e.g. be assessed in a study as disclosed in the following example of an advanced stage human tumor xenograft model:

On day 1 of the study, $5 \times 10^6$ cells of a human target cell antigen positive cancer cell line are subcutaneously injected in the right dorsal flank of female NOD/SCID mice. When the mean tumor volume reaches about 100 mm$^3$, in vitro expanded human CD3 positive T cells are transplanted into the mice by injection of about $2 \times 10^7$ cells into the peritoneal cavity of the animals. Mice of vehicle control group 1 do not receive effector cells and are used as an untransplanted control for comparison with vehicle control group 2 (receiving effector cells) to monitor the impact of T cells alone on tumor growth. The antibody treatment starts when the mean tumor volume reaches about 200 mm$^3$. The mean tumor size of each treatment group on the day of treatment start should not be statistically different from any other group (analysis of variance). Mice are treated with 0.5 mg/kg/day of a target cell antigen/CD3 bispecific antibody construct by intravenous bolus injection for about 15 to 20 days. Tumors are measured by caliper during the study and progress evaluated by intergroup comparison of tumor volumes (TV). The tumor growth inhibition T/C [%] is determined by calculating TV as T/C %=100×(median TV of analyzed group)/(median TV of control group 2).

The skilled person knows how to modify or adapt certain parameters of this study, such as the number of injected tumor cells, the site of injection, the number of transplanted human T cells, the amount of bispecific antibody constructs to be administered, and the timelines, while still arriving at a meaningful and reproducible result. Preferably, the tumor growth inhibition T/C [%] is ≤70 or ≤60, more preferably ≤50 or ≤40, even more preferably ≤30 or ≤20 and most preferably ≤10 or ≤5 or even ≤2.5.

In one embodiment, the bispecific antibody constructs of the present invention exhibit high monomer yields under standard research scale conditions, e.g., in a standard two-step purification process. Preferably the monomer yield of the antibody constructs according to the invention is ≥0.25 mg/L supernatant, more preferably ≥0.5 mg/L, even more preferably ≥1 mg/L, and most preferably ≥3 mg/L supernatant.

Likewise, the yield of the dimeric antibody construct isoforms and the monomer percentage (i.e., monomer:(monomer+dimer)) of the antibody constructs can be determined. The productivity of monomeric and dimeric antibody constructs and the calculated monomer percentage can e.g. be obtained in the SEC purification step of culture supernatant from standardized research-scale production in roller bottles. In one embodiment, the monomer percentage of the antibody constructs is ≥80%, more preferably ≥85%, even more preferably ≥90%, and most preferably ≥95%.

In a further embodiment, the percentage of identity to human germline of the antibody constructs according to the invention is ≥70% or ≥75%, more preferably ≥80% or ≥85%, even more preferably ≥90%, and most preferably ≥95%. Identity to human antibody germline gene products is thought to be an important feature to reduce the risk of therapeutic proteins to elicit an immune response against the drug in the patient during treatment. Hwang & Foote ("Immunogenicity of engineered antibodies"; Methods 36 (2005) 3-10) demonstrate that the reduction of non-human portions of drug antibody constructs leads to a decrease of risk to induce anti-drug antibodies in the patients during treatment. By comparing an exhaustive number of clinically evaluated antibody drugs and the respective immunogenicity data, the trend is shown that humanization of the V-regions of antibodies makes the protein less immunogenic (average 5.1% of patients) than antibodies carrying unaltered non-human V regions (average 23.59% of patients). A higher degree of identity to human sequences is hence desirable for V-region based protein therapeutics in the form of antibody constructs. For this purpose of determining the germline identity, the V-regions of VL can be aligned with the amino acid sequences of human germline V segments and J segments (http://vbase.mrc-cpe.cam.ac.uk) using Vector NTI software and the amino acid sequence calculated by dividing the identical amino acid residues by the total number of amino acid residues of the VL in percent. The same can be for the VH segments (http://vbase.mrc-cpe.cam.ac.uk/) with the exception that the VH CDR3 may be excluded due to its high diversity and a lack of existing human germline VH CDR3 alignment partners.

Recombinant techniques can then be used to increase sequence identity to human antibody germline genes.

In one embodiment, the antibody constructs have a preferred plasma stability (ratio of EC50 with plasma to EC50 w/o plasma) of ≤5, more preferably ≤4, even more preferably ≤3, and most preferably ≤2. The plasma stability of an antibody construct can be tested by incubation of the construct in human plasma at 37° C. for 24 hours followed by EC50 determination in a 51chromium release cytotoxicity assay. The effector cells in the cytotoxicity assay can be stimulated enriched human CD8 positive T cells. Target cells can e.g. be CHO cells transfected with the target antigen, e.g., CDH19. The effector to target cell (E:T) ratio can be chosen as 10:1. The human plasma pool used for this purpose is derived from the blood of healthy donors collected by EDTA coated syringes. Cellular components are removed by centrifugation and the upper plasma phase is collected and subsequently pooled. As control, antibody constructs are diluted immediately prior to the cytotoxicity assay in RPMI-1640 medium. The plasma stability is calculated as ratio of EC50 (after plasma incubation) to EC50 (control).

It is preferred that the monomer to dimer conversion of antibody constructs of the invention is low. The conversion can be measured under different conditions and analyzed by high performance size exclusion chromatography. For example, incubation of the monomeric isoforms of the antibody constructs can be carried out for 7 days at 37° C. and concentrations of e.g. 100 µg/ml or 250 µg/ml in an incubator. Under these conditions, it is preferred that the antibody constructs of the invention show a dimer percentage that is ≤5%, more preferably ≤4%, even more preferably ≤3%, even more preferably ≤2.5%, even more preferably ≤2%, even more preferably ≤1.5%, and most preferably ≤1%.

It is also preferred that the bispecific antibody constructs of the present invention present with very low dimer conversion after a number of freeze/thaw cycles. For example, the antibody construct monomer is adjusted to a concentration of 250 µg/ml e.g. in SEC running buffer and subjected to three freeze/thaw cycles (freezing at −80° C. for 30 min followed by thawing for 30 min at room temperature), followed by high performance SEC to determine the percentage of initially monomeric antibody construct, which had been converted into dimeric antibody construct. Preferably the dimer percentages of the bispecific antibody constructs are ≤5%, more preferably ≤4%, even more preferably ≤3%, even more preferably ≤2.5%, even more preferably ≤2%, even more preferably ≤1.5%, and most preferably ≤1%, for example after three freeze/thaw cycles.

The bispecific antibody constructs of the present invention preferably show a favorable thermostability with melting temperatures above 60° C. This parameter can be determined as follows: Temperature melting curves are determined by Differential Scanning calorimetry (DSC) to determine intrinsic biophysical protein stabilities of the antibody constructs. These experiments are performed using a MicroCal LLC (Northampton, Mass., U.S.A) VP-DSC device. The energy uptake of a sample containing an antibody construct is recorded from 20° C. to 90° C. compared to a sample containing only the formulation buffer. The antibody constructs are adjusted to a final concentration of 250 µg/ml e.g. in SEC running buffer. For recording of the respective melting curve, the overall sample temperature is increased stepwise. At each temperature T energy uptake of the sample and the formulation buffer reference is recorded. The difference in energy uptake Cp (kcal/mole/° C.) of the sample minus the reference is plotted against the respective temperature. The melting temperature is defined as the temperature at the first maximum of energy uptake.

In a further embodiment the antibody construct according to the invention is stable at acidic pH. The more tolerant the antibody construct behaves at unphysiologic pH such as pH 5.5 (a pH which is required to run e.g. a cation exchange chromatography), the higher is the recovery of the antibody construct eluted from an ion exchange column relative to the total amount of loaded protein. Recovery of the antibody construct from an ion (e.g., cation) exchange column at pH 5.5 is preferably ≥30%, more preferably ≥40%, more preferably ≥50%, even more preferably ≥60%, even more preferably ≥70%, even more preferably ≥80%, and most preferably ≥90%.

It is furthermore envisaged that the bispecific antibody constructs of the present invention exhibit therapeutic efficacy or anti-tumor activity. This can e.g. be assessed in a study as disclosed in the following example of an advanced stage human tumor xenograft model.

In an alternative embodiment the invention provides a polynucleotide encoding an antibody construct of the invention.

A polynucleotide is a biopolymer composed of 13 or more nucleotide monomers covalently bonded in a chain. DNA (such as cDNA) and RNA (such as mRNA) are examples of polynucleotides with distinct biological function. Nucleotides are organic molecules that serve as the monomers or subunits of nucleic acid molecules like DNA or RNA. The nucleic acid molecule or polynucleotide can be double stranded and single stranded, linear and circular. It is preferably comprised in a vector which is preferably comprised in a host cell. Said host cell is, e.g. after transformation or transfection with the vector or the polynucleotide of the invention, capable of expressing the antibody construct. For that purpose the polynucleotide or nucleic acid molecule is operatively linked with control sequences.

The genetic code is the set of rules by which information encoded within genetic material (nucleic acids) is translated into proteins. Biological decoding in living cells is accomplished by the ribosome which links amino acids in an order specified by mRNA, using tRNA molecules to carry amino acids and to read the mRNA three nucleotides at a time. The code defines how sequences of these nucleotide triplets, called codons, specify which amino acid will be added next during protein synthesis. With some exceptions, a three-nucleotide codon in a nucleic acid sequence specifies a single amino acid. Because the vast majority of genes are encoded with exactly the same code, this particular code is often referred to as the canonical or standard genetic code. While the genetic code determines the protein sequence for a given coding region, other genomic regions can influence when and where these proteins are produced.

In a further alternative embodiment the invention provides a vector comprising a polynucleotide of the invention.

A vector is a nucleic acid molecule used as a vehicle to transfer (foreign) genetic material into a cell. The term "vector" encompasses—but is not restricted to—plasmids, viruses, cosmids and artificial chromosomes. In general, engineered vectors comprise an origin of replication, a multicloning site and a selectable marker. The vector itself is generally a nucleotide sequence, commonly a DNA sequence, that comprises an insert (transgene) and a larger sequence that serves as the "backbone" of the vector. Modern vectors may encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Transfection" is the process of deliberately introducing nucleic acid molecules or polynucleotides (including vectors) into target cells. The term is mostly used for non-viral methods in eukaryotic cells. Transduction is often used to describe virus-mediated transfer of nucleic acid molecules or polynucleotides. Transfection of animal cells typically involves opening transient pores or "holes" in the cell membrane, to allow the uptake of material. Transfection can be carried out using calcium phosphate, by electroporation, by cell squeezing or by mixing a cationic lipid with the material to produce liposomes, which fuse with the cell membrane and deposit their cargo inside.

The term "transformation" is used to describe non-viral transfer of nucleic acid molecules or polynucleotides (including vectors) into bacteria, and also into non-animal eukaryotic cells, including plant cells. Transformation is hence the genetic alteration of a bacterial or non-animal eukaryotic cell resulting from the direct uptake through the cell membrane(s) from its surroundings and subsequent incorporation of exogenous genetic material (nucleic acid molecules). Transformation can be effected by artificial means. For transformation to happen, cells or bacteria must be in a state of competence, which might occur as a time-limited response to environmental conditions such as starvation and cell density.

Moreover, in an additional alternative embodiment, the invention provides a host cell transformed or transfected with the polynucleotide of the invention or with the vector of the invention.

As used herein, the terms "host cell" or "recipient cell" are intended to include any individual cell or cell culture that can be or has/have been recipients of vectors, exogenous nucleic acid molecules, and polynucleotides encoding the antibody construct of the present invention; and/or recipients of the antibody construct itself. The introduction of the respective material into the cell is carried out by way of transformation, transfection and the like. The term "host cell" is also intended to include progeny or potential progeny of a single cell. Because certain modifications may occur in succeeding generations due to either natural, accidental, or deliberate mutation or due to environmental influences, such progeny may not, in fact, be completely identical (in morphology or in genomic or total DNA complement) to the parent cell, but is still included within the scope of the term as used herein. Suitable host cells include prokaryotic or eukaryotic cells, and also include but are not limited to bacteria, yeast cells, fungi cells, plant cells, and animal cells such as insect cells and mammalian cells, e.g., murine, rat, macaque or human.

The antibody construct of the invention can be produced in bacteria. After expression, the antibody construct of the invention is isolated from the *E. coli* cell paste in a soluble fraction and can be purified through, e.g., affinity chromatography and/or size exclusion. Final purification can be carried out similar to the process for purifying antibody expressed e.g., in CHO cells.

In addition to prokaryotes, eukaryotic microbes such as filamentous fungi or yeast are suitable cloning or expression hosts for the antibody construct of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe*, Kluyveromyces hosts such as *K. lactis, K. fragilis* (ATCC 12424), *K. bulgaricus* (ATCC 16045), *K. wickeramii* (ATCC 24178), *K. waltii* (ATCC 56500), *K. drosophilarum* (ATCC 36906), *K. thermotolerans*, and *K. marxianus*; yarrowia (EP 402 226); *Pichia pastoris* (EP 183 070); Candida; *Trichoderma reesia* (EP 244 234); *Neurospora crassa; Schwanniomyces* such as *Schwanniomyces occidentalis*; and filamentous fungi such as *Neurospora, Penicillium, Tolypocladium*, and *Aspergillus* hosts such as *A. nidulans* and *A. niger*.

Suitable host cells for the expression of glycosylated antibody construct of the invention are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, petunia, tomato, Arabidopsis and tobacco can also be used as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36:59 (1977)); baby hamster kidney cells (BHK, ATCC CCL 10); Chinese hamster ovary cells/-DHFR (CHO, Urlaub et al., Proc. Natl. Acad. Sci. USA 77: 4216 (1980)); mouse sertoli cells (TM4, Mather, Biol. Reprod. 23: 243-251 (1980)); monkey kidney cells (CVI ATCC CCL 70); African green monkey kidney cells (VERO-76, ATCC CRL1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, 1413 8065); mouse mammary tumor (MMT 060562, ATCC CCL5 1); TRI cells (Mather et al., Annals N. Y Acad. Sci. (1982) 383: 44-68); MRC 5 cells; FS4 cells; and a human hepatoma line (Hep G2).

The invention also provides a process for the production of a antibody construct of the invention, said process comprising culturing a host cell of the invention under conditions allowing the expression of the antibody construct of the invention and recovering the produced antibody construct from the culture.

As used herein, the term "culturing" refers to the in vitro maintenance, differentiation, growth, proliferation and/or propagation of cells under suitable conditions in a medium. The term "expression" includes any step involved in the production of an antibody construct of the invention including, but not limited to, transcription, post-transcriptional modification, translation, post-translational modification, and secretion.

When using recombinant techniques, the antibody construct can be produced intracellularly, in the periplasmic space, or directly secreted into the medium. If the antibody construct is produced intracellularly, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of E. coli. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody construct of the invention prepared from the host cells can be recovered or purified using, for example, hydroxylapatite chromatography, gel electrophoresis, dialysis, and affinity chromatography. Other techniques for protein purification such as fractionation on an ion-exchange column, ethanol precipitation, Reverse Phase HPLC, chromatography on silica, chromatography on heparin SEPHAROSE™, chromatography on an anion or cation exchange resin (such as a polyaspartic acid column), chromato-focusing, SDS-PAGE, and ammonium sulfate precipitation are also available depending on the antibody to be recovered. Where the antibody construct of the invention comprises a CH3 domain, the Bakerbond ABX resin (J. T. Baker, Phillipsburg, N.J.) is useful for purification.

Affinity chromatography is a preferred purification technique. The matrix to which the affinity ligand is attached is most often agarose, but other matrices are available. Mechanically stable matrices such as controlled pore glass or poly (styrenedivinyl) benzene allow for faster flow rates and shorter processing times than can be achieved with agarose.

Furthermore, the invention provides a pharmaceutical composition comprising an antibody construct of the invention, or an antibody construct produced according to the process of the invention.

According to one embodiment of the invention the antibody construct of the invention, or produced according to the process of the invention is used in the prevention, treatment or amelioration of a disease selected from a proliferative disease, a tumorous disease, a viral disease or an immunological disorder.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

The term "amelioration" as used herein refers to any improvement of the disease state of a patient, by the administration of an antibody construct according to the invention to a subject in need thereof. Such an improvement may also be seen as a slowing or stopping of the progression patient's disease. The term "prevention" as used herein means the avoidance of the occurrence or re-occurrence of a patient having a disease as specified herein, by the administration of an antibody construct according to the invention to a subject in need thereof.

The term "disease" refers to any condition that would benefit from treatment with the antibody construct or the pharmaceutic composition described herein. This includes chronic and acute disorders or diseases including those pathological conditions that predispose the mammal to the disease in question.

In one embodiment the invention provides a method for the treatment or amelioration of a proliferative disease, a tumorous disease, a viral disease or an immunological disorder, comprising the step of administering to a subject in need thereof the antibody construct of the invention, or produced according to the process of the invention.

The terms "subject in need" or those "in need of treatment" includes those already with the disorder, as well as those in which the disorder is to be prevented. The subject in need or "patient" includes human and other mammalian subjects that receive either prophylactic or therapeutic treatment.

The antibody construct of the invention will generally be designed for specific routes and methods of administration, for specific dosages and frequencies of administration, for specific treatments of specific diseases, with ranges of bio-availability and persistence, among other things. The materials of the composition are preferably formulated in concentrations that are acceptable for the site of administration.

Formulations and compositions thus may be designed in accordance with the invention for delivery by any suitable route of administration. In the context of the present invention, the routes of administration include, but are not limited to topical routes (such as epicutaneous, inhalational, nasal, ophthalmic, auricular/aural, vaginal, mucosal);
enteral routes (such as oral, gastrointestinal, sublingual, sublabial, buccal, rectal); and
parenteral routes (such as intravenous, intraarterial, intraosseous, intramuscular, intracerebral, intracerebroventricular, epidural, intrathecal, subcutaneous, intraperitoneal, extra-amniotic, intraarticular, intracardiac, intradermal, intralesional, intrauterine, intravesical, intravitreal, transdermal, intranasal, transmucosal, intrasynovial, intraluminal).

The pharmaceutical compositions and the antibody construct of this invention are particularly useful for parenteral administration, e.g., subcutaneous or intravenous delivery, for example by injection such as bolus injection, or by infusion such as continuous infusion. Pharmaceutical compositions may be administered using a medical device. Examples of medical devices for administering pharmaceutical compositions are described in U.S. Pat. Nos. 4,475,196; 4,439,196; 4,447,224; 4,447, 233; 4,486,194; 4,487,603; 4,596,556; 4,790,824; 4,941,880; 5,064,413; 5,312,335; 5,312,335; 5,383,851; and 5,399,163.

In particular, the present invention provides for an uninterrupted administration of the suitable composition. As a non-limiting example, uninterrupted or substantially uninterrupted, i.e. continuous administration may be realized by a small pump system worn by the patient for metering the influx of therapeutic agent into the body of the patient. The pharmaceutical composition comprising the antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of the antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may also be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

The compositions of the present invention can be administered to the subject at a suitable dose which can be determined e.g. by dose escalating studies by administration of increasing doses of the antibody construct of the invention exhibiting cross-species specificity described herein to non-chimpanzee primates, for instance macaques. As set forth above, the antibody construct of the invention exhibiting cross-species specificity described herein can be advantageously used in identical form in preclinical testing in non-chimpanzee primates and as drug in humans. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts or doses effective for this use will depend on the condition to be treated (the indication), the delivered antibody construct, the therapeutic context and objectives, the severity of the disease, prior therapy, the patient's clinical history and response to the therapeutic agent, the route of administration, the size (body weight, body surface or organ size) and/or condition (the age and general health) of the patient, and the general state of the patient's own immune system. The proper dose can be adjusted according to the judgment of the attending physician such that it can be administered to the patient once or over a series of administrations, and in order to obtain the optimal therapeutic effect.

A typical dosage may range from about 0.1 µg/kg to up to about 30 mg/kg or more, depending on the factors mentioned above. In specific embodiments, the dosage may range from 1.0 µg/kg up to about 20 mg/kg, optionally from 10 µg/kg up to about 10 mg/kg or from 100 µg/kg up to about 5 mg/kg.

A therapeutic effective amount of an antibody construct of the invention preferably results in a decrease in severity of disease symptoms, an increase in frequency or duration of disease symptom-free periods or a prevention of impairment or disability due to the disease affliction. For treating target cell antigen-expressing tumors, a therapeutically effective amount of the antibody construct of the invention, e.g. an anti-target cell antigen/anti-CD3 antibody construct, preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy in human tumors.

The pharmaceutical composition can be administered as a sole therapeutic or in combination with additional therapies such as anti-cancer therapies as needed, e.g. other proteinaceous and non-proteinaceous drugs. These drugs may be administered simultaneously with the composition comprising the antibody construct of the invention as defined herein or separately before or after administration of said antibody construct in timely defined intervals and doses.

The term "effective and non-toxic dose" as used herein refers to a tolerable dose of an inventive antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

Finally, the invention provides a kit comprising an antibody construct of the invention or produced according to the process of the invention, a vector of the invention and/or a host cell of the invention.

In the context of the present invention, the term "kit" means two or more components—one of which corresponding to the antibody construct, the pharmaceutical composition, the vector or the host cell of the invention—packaged together in a container, recipient or otherwise. A kit can hence be described as a set of products and/or utensils that are sufficient to achieve a certain goal, which can be marketed as a single unit.

The kit may comprise one or more recipients (such as vials, ampoules, containers, syringes, bottles, bags) of any appropriate shape, size and material (preferably waterproof, e.g. plastic or glass) containing the antibody construct or the pharmaceutical composition of the present invention in an appropriate dosage for administration (see above). The kit may additionally contain directions for use (e.g. in the form of a leaflet or instruction manual), means for administering the antibody construct of the present invention such as a syringe, pump, infuser or the like, means for reconstituting the antibody construct of the invention and/or means for diluting the antibody construct of the invention.

The invention also provides kits for a single-dose administration unit. The kit of the invention may also contain a first recipient comprising a dried/lyophilized antibody construct and a second recipient comprising an aqueous formulation. In certain embodiments of this invention, kits containing single-chambered and multi-chambered pre-filled syringes (e.g., liquid syringes and lyosyringes) are provided.

BRIEF DESCRIPTION OF THE DRAWINGS

FIG. 7A FACS-based activation assay (48 h) with human PBMC (donors #669, #729, #736) and Influenza specific BITE® antibody constructs; BiTE® start concentration=1 pg/mL (1:10 dilution);

FIG. 7B FACS-based activation assay (48 h) with human PBMC (donors #453, #458, #551) and DLL3 specific BiTE® antibody constructs; BiTE® start concentration=1 pg/mL (1:10 dilution);

FIG. 7C Human PBMC were cultured in the absence of target cells with Mesothelin BiTE® or the HSA-variant of the Mesothelin BiTE® antibody construct for 48 h. The expression of the activation marker CD69 on T cells was determined by immunostaining and flow cytometry.

FIG. 8A: Isolated T cells from healthy human donors were co-cultured in the presence or absence of target cells (Raji) (E:T cell ratio 10:1) and Full length HSA-CD19 BITE® for 48 h. The expression of the activation markers CD69 or CD25 on T cells was determined by immunostaining and flow cytometry;

FIG. 8B: Isolated T cells from healthy human donors were co-cultured in the presence or absence of target cells (Raji) (E:T cell ratio 10:1) and Full length HSA-CD20 BITE® for 48 h. The expression of the activation markers CD69 or CD25 on T cells was determined by immunostaining and flow cytometry;

FIG. 8C: Human PBMC were co-cultured in the presence or absence of target cells (U251vIII) (E:T cell ratio 10:1) and EGFRvIII-BiTE® or the HSA-variant of the EGFRvIII-BITE® for 48 h. The expression of the activation markers CD69 on T cells was determined by immunostaining and flow cytometry.

Tumor-accumulation of CDH19-HALB BiTE® antibody construct.

FIG. 10:

Mean PK profiles of six BiTE®-HALB fusion proteins after single dose administration in cynomolgus monkeys.

FIG. 11:

Pharmacokinetic profiles of CD33-1×I2C-HALB and CD33-2×I2C6-HALB constructs administered in repeated dose schedules at different doses and different consecutive schedules. For reasons of comparability, described repeated dose profiles are dose-normalized to 120 µg/kg. The PK profile of the reference compound 8 administered at 30 µg/kg/day, cIV for 7 days, is shown in orange.

FIG. 12:

Pharmacokinetic profiles of modified HALB HLE modalities based on the EGFRvIII-BiTE antibody construct. Seven different EGFRvIII-HLE BiTE antibody constructs generated by mutations within the HALB wild-type sequence were tested in the cynomolgus monkey in the context of a pharmacokinetic (PK) study. Differences in the hALB variants are based on different, increased FcRn-binding affinities.

It should be understood that the inventions herein are not limited to particular methodology, protocols, or reagents, as such can vary. The discussion and examples provided herein are presented for the purpose of describing particular embodiments only and are not intended to limit the scope of the present invention, which is defined solely by the claims.

All publications and patents cited throughout the text of this specification (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention. To the extent the material incorporated by reference contradicts or is inconsistent with this specification, the specification will supersede any such material.

EXAMPLES

The following examples are provided for the purpose of illustrating specific embodiments or features of the present invention. These examples should not be construed as to limit the scope of this invention. The examples are included for purposes of illustration, and the present invention is limited only by the claims.

Example 1

T cell activation of BiTE® molecules in the presence and the absence of an albumin fusion at the C-terminus of the molecule BiTE® constructs (serial dilutions: 0.1 pg/mL-1 µg/mL):
1. CDH19 2G6 302×I2C-H6; 258.7 µg/mL (SoW0416; Aliquot Lot: 140514_APu01); Untagged BiTE®
2. CDH19 2G6 302×I2C-HALB-DY-H6; 260 µg/mL (SoW0445; Aliquot Lot: 140514_APu03); Half-life extended full length Human PBMC effector cells (4 donors; #875, #889, #891, #895)

48 h incubation time

Figure 6:
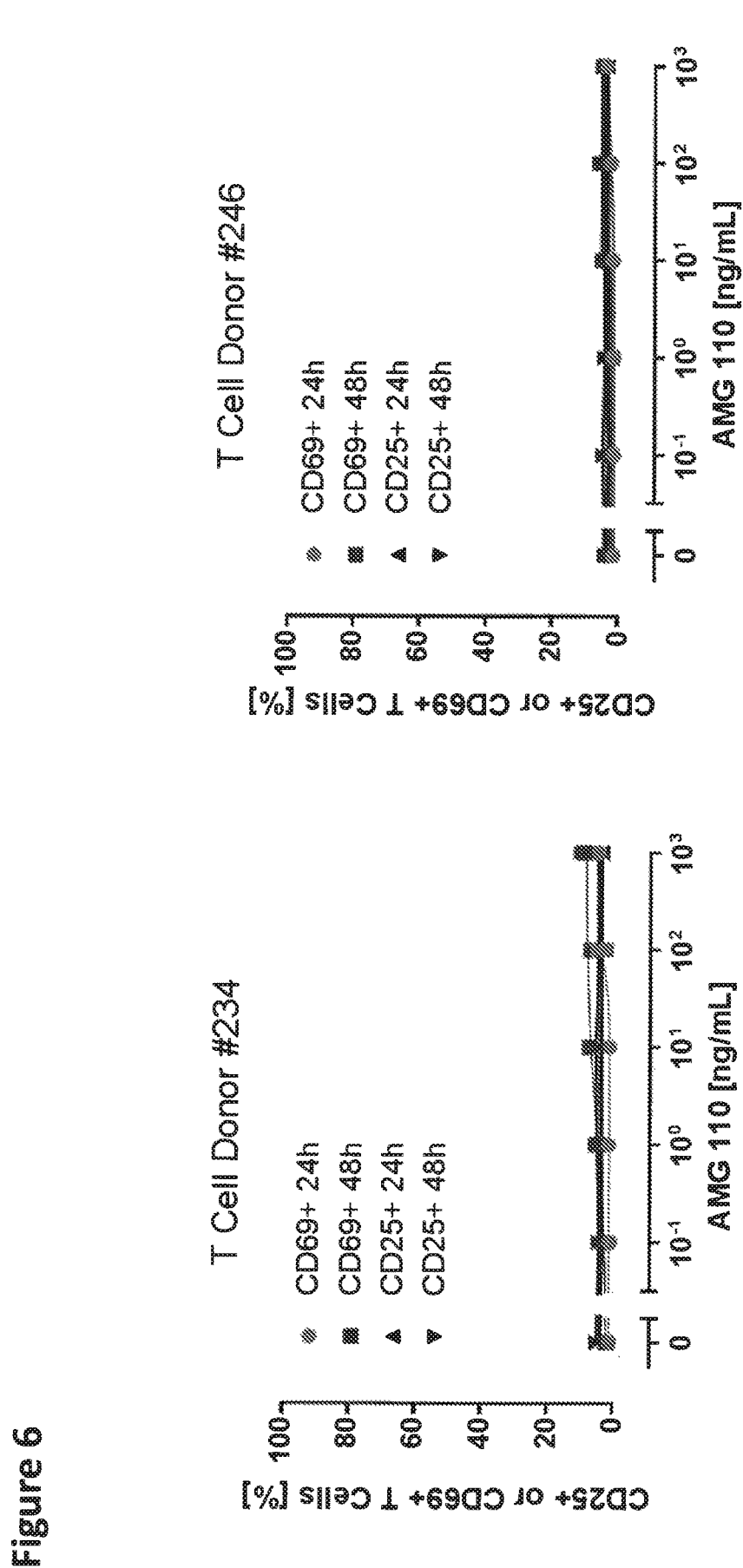
FIG. 6:
Absence of "unspecific" T cell activation for bispecific single chain antibody constructs comprising a human/chimpanzee specific CD3 binding domain using AMG 110.
Figure 7A:
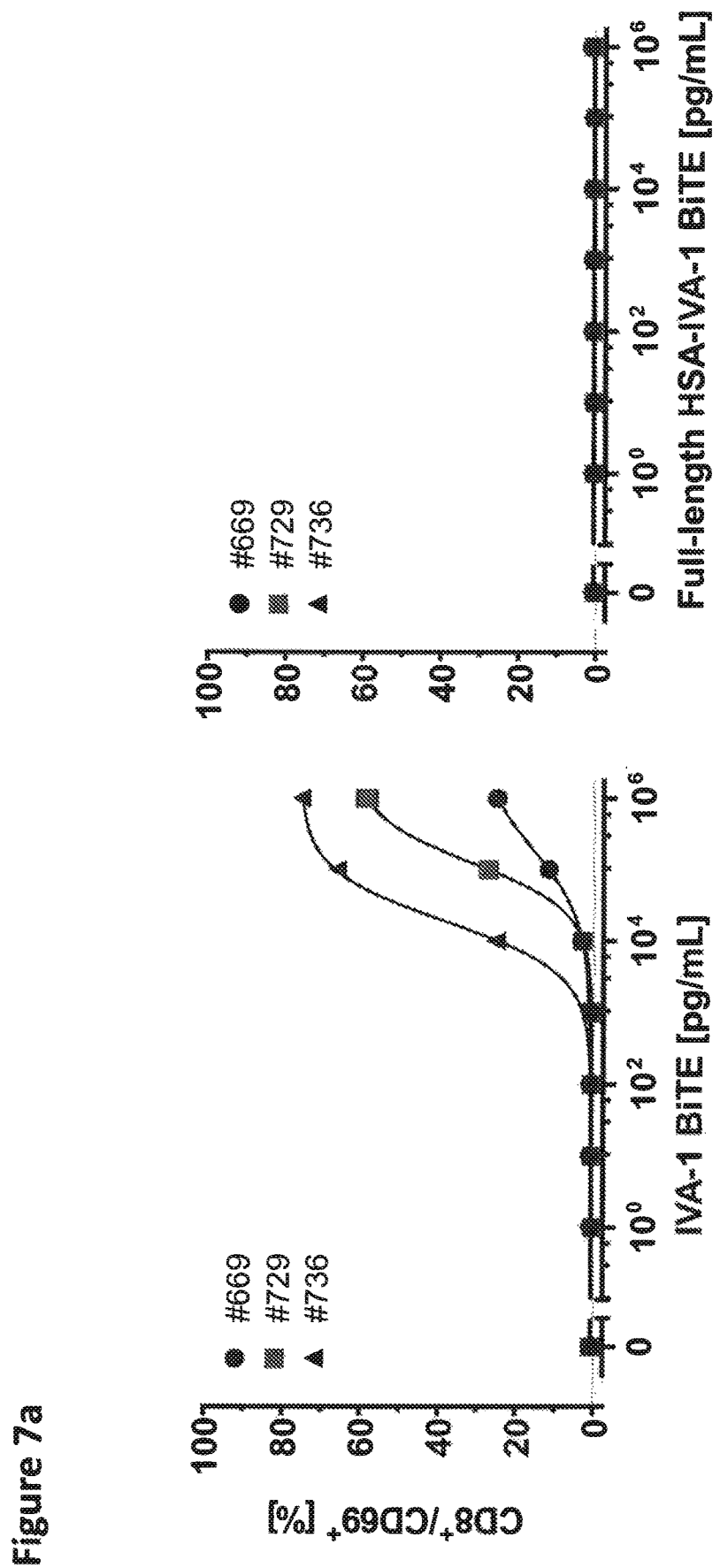
FIGS. 7A-7C:
T activation by bispecific antibody constructs binding to different cell surface target structures in absence and presence of an albumin fusion at the C-terminus of the molecule. Expression of CD25 and CD69 on T cells was determined by flow cytometry.
Figure 7B:
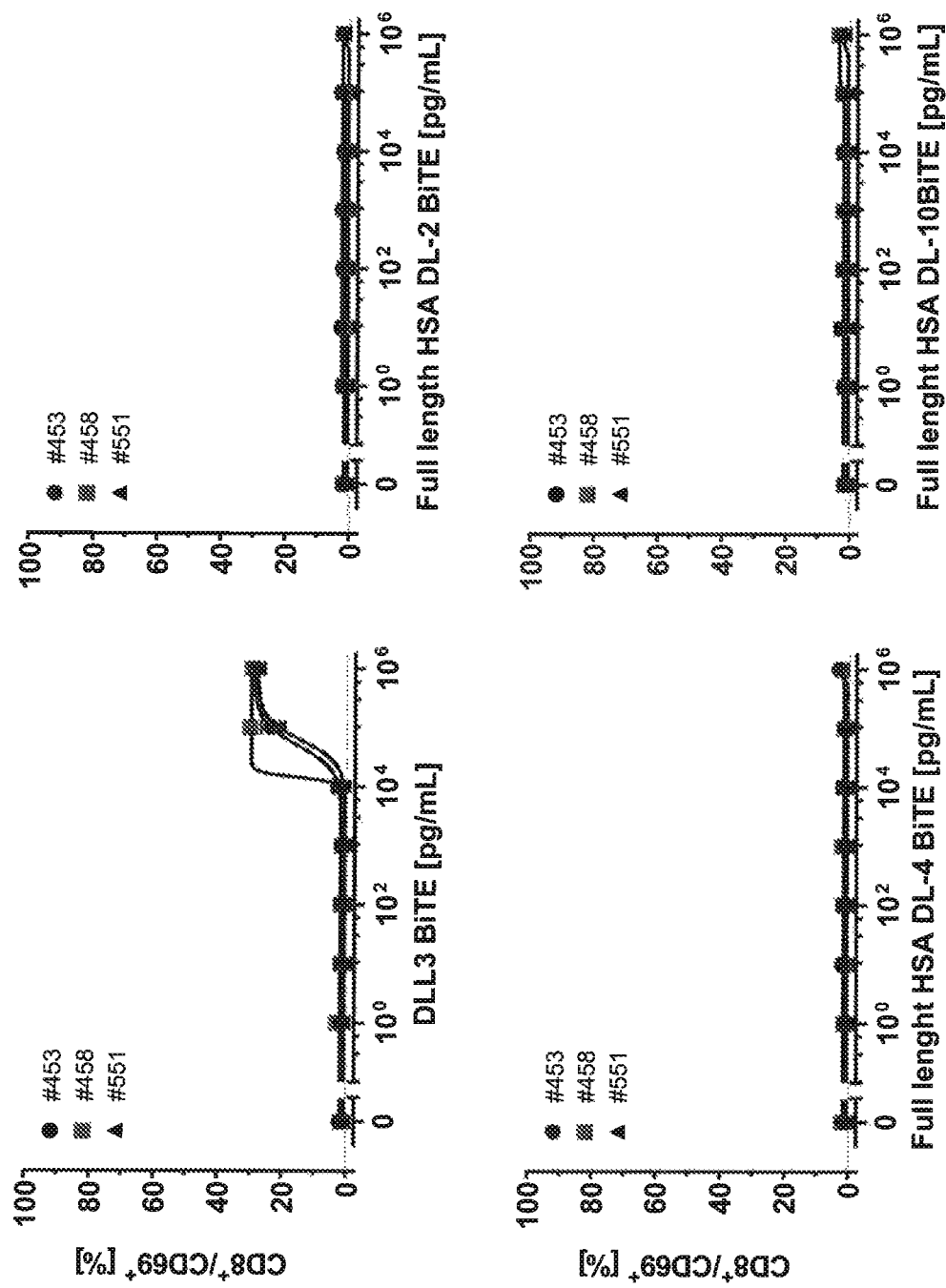
Figure 7C:
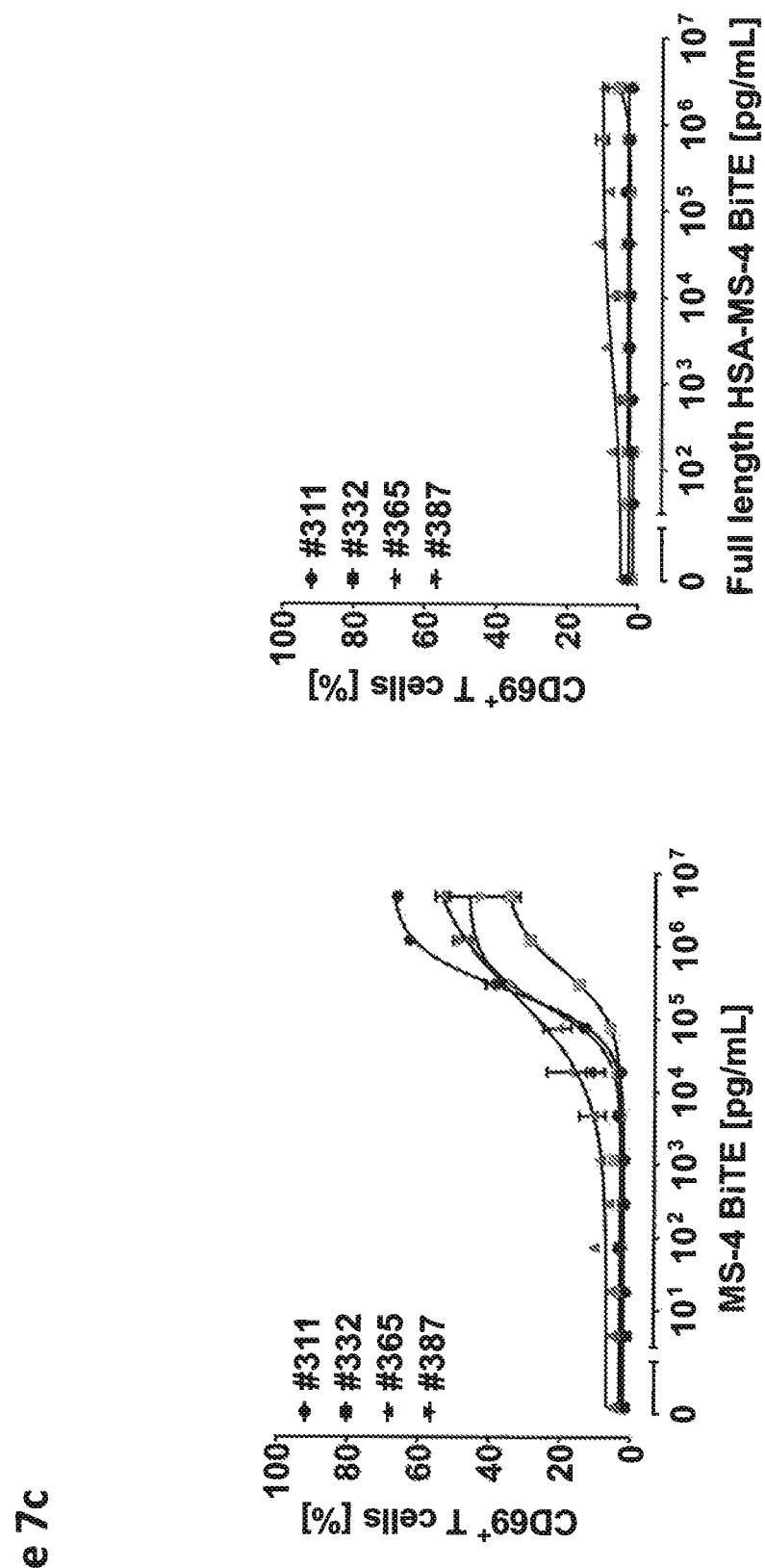

Determination of CD25 and CD69 expression on CD4+ and CD8+ T cells with flow cytometer and antigen-specific conjugates mAb In a similar setting the capacity of different BiTE® antibody constructs to activate T cell was analyzed. Those BiTE® antibody constructs do not comprise the CD3 specific binding domain of bispecific single chain antibody constructs of the invention but merely a human/chimpanzee specific CD3 binding domain. The corresponding BiTE® antibody construct is AMG 110, which is an EpCAM and CD3 specific BiTE® antibody construct. PBMC were incubated with increasing AMG 110 concentrations for 24 or 48 hrs, T cell activation was determined by staining for CD25 or CD69 surface expression by flow cytometry on a BD FACSCanto II instrument. The result of this analysis is shown in FIG. 6. Moreover, the generic modality of eliminating the target independent T cell activation in the defined extreme high BiTE® antibody construct concentrations was demonstrated for a greater number of additional bispecific antibody constructs with specificity for different target structures as shown in FIG. 7 (7a: Influenza A antigen; 7b: DLL3; 7c: mesothelin (MSLN)).

Example 2

Bispecific Binding and Interspecies Cross-Reactivity

For confirmation of binding to human and cyno CDH19 and to human and macaque CD3, bispecific antibodies were tested by flow cytometry using indicated cell lines. CHO cells transfected with human CDH19, with cyno CDH19, the human melanoma cell line CHL-1 expressing native human CDH19, CD3-expressing human T cell leukemia cell line HPB-ALL (DSMZ, Braunschweig, ACC483) and the CD3-expressing macaque T cell line 4119LnPx (Knappe A, et al., Blood, 2000, 95, 3256-3261) were used as antigen positive cell lines. Moreover, untransfected CHO cells were used as negative control.

For flow cytometry 200,000 cells of the respective cell lines were incubated for 30 min on ice with 50 µl of purified bispecific antibody at a concentration of ≤5 µg/ml. The cells were washed twice in PBS/10% FCS and binding of the constructs was detected with a murine anti-His antibody (AbD Serotec; diluted 1:1000 in 50 µl PBS/10% FCS). After washing, bound anti-His antibodies were detected with an Fc gamma-specific antibody (Dianova) conjugated to phycoerythrin, diluted 1:100 in PBS/10% FCS. Samples were measured by flow cytometry on a FACSCanto II instrument and analyzed by FACSDiva software (both from Becton Dickinson).

Figure 1:
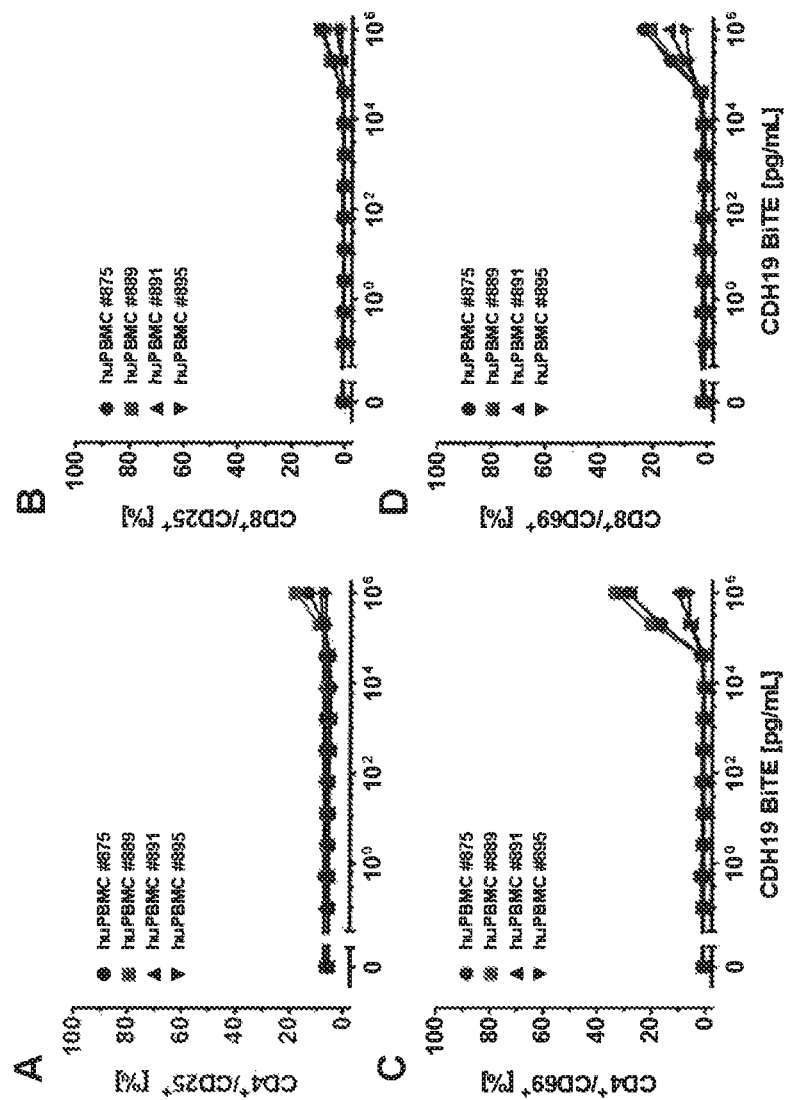
FIGS. 1A-1D:
T activation of BiTE® antibody constructs in the absence of an albumin fusion at the C-terminus of the molecule. Expression of CD25 and CD69 on CD4$^+$ (FIG. 1A and FIG. 1C) and CD8$^+$ (FIG. 1B and FIG. 1D) T cells was determined by flow cytometry.
Figure 2:
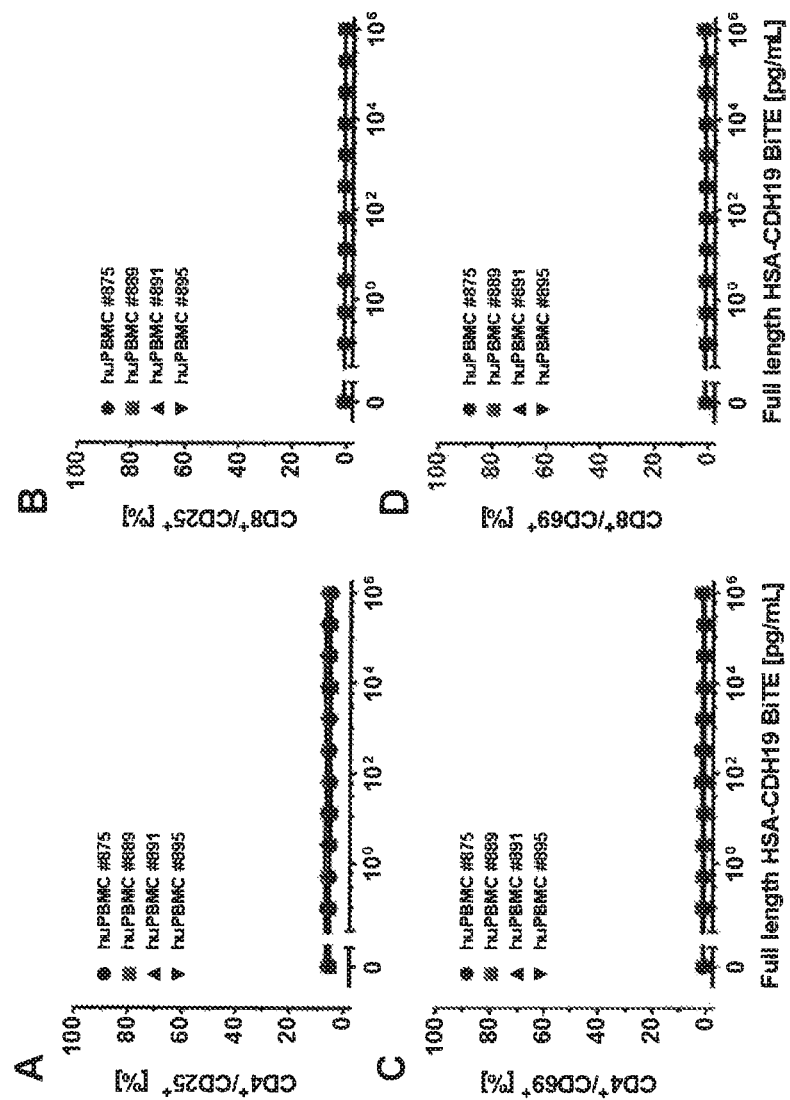
FIGS. 2A-2D:
T activation of BiTE® antibody constructs in the presence (lower panel) of an albumin fusion at the C-terminus of the molecule. Expression of CD25 and CD69 on CD4$^+$ (FIG. 2A and FIG. 2C) and CD8$^+$ (FIG. 2B and FIG. 2D) T cells was determined by flow cytometry.
Figure 3:
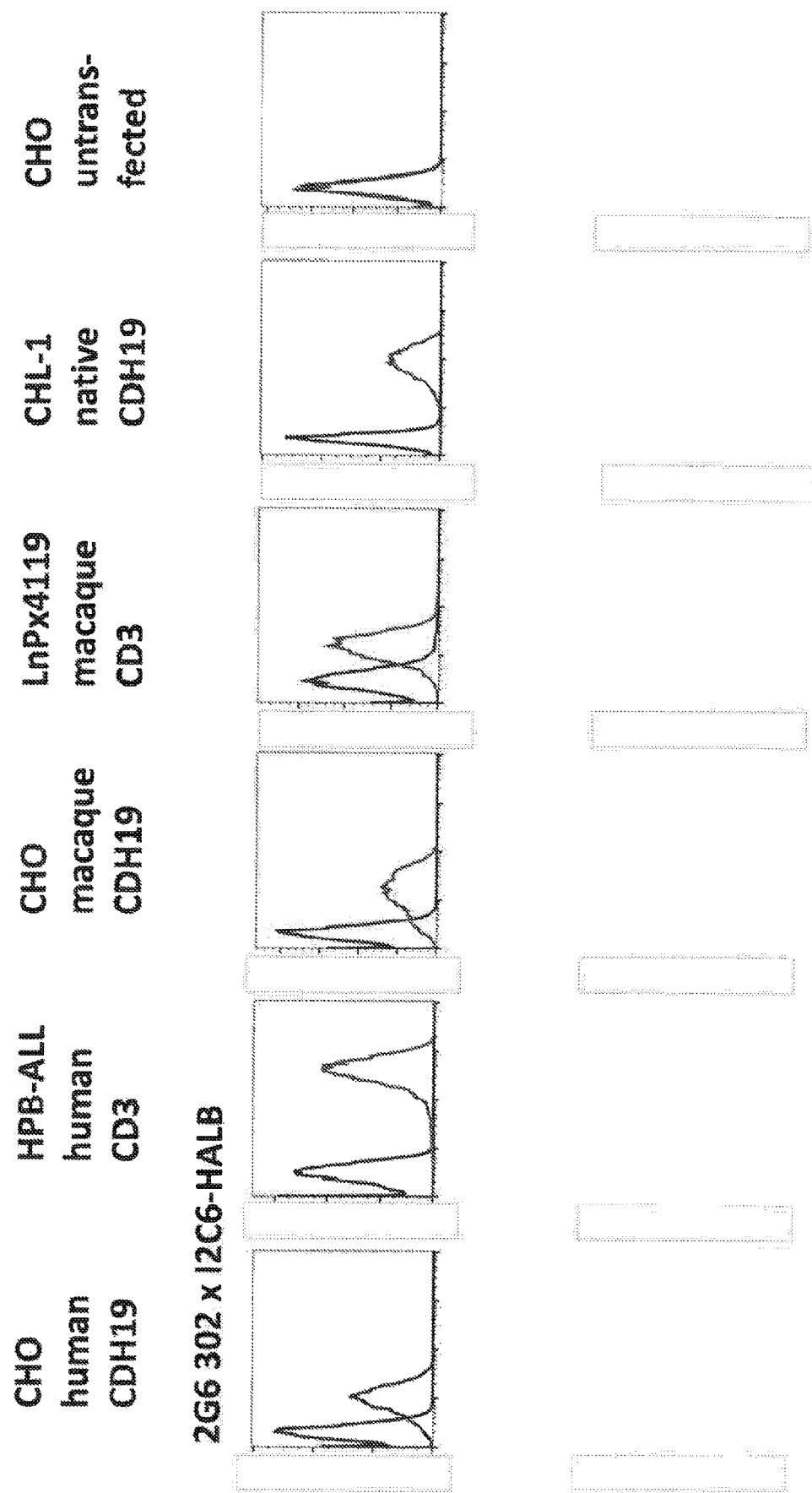
FIG. 3:
FACS analysis of CDH19/CD3 bispecific antibodies on indicated cell lines: 1) CHO cells stably transfected with human CDH19, 2) human CD3 positive human T cell line HBP-ALL, 3) CHO cells stably transfected with cynomolgus CDH19, 4) macaque T cell line 4119 LnPx, 5) human melanoma cell line CHL-1 expressing native human CDH19, 6) untransfected CHO cells. Negative controls [1] to 6)]: detection antibodies without prior CDH19/CD3 bispecific antibody.

The CDH19/CD3 bispecific antibodies stained CHO cells transfected with human CDH19, cyno CDH19, the human CDH19-expressing melanoma cell lines CHL-1 as well as human and macaque T cells. Moreover, there was no staining of untransfected CHO cells (see FIG. 3).

Example 3

Cytotoxic Activity

Target Cell Labeling

For the analysis of cell lysis in flow cytometry assays, the fluorescent membrane dye $DiOC_{18}$ (DiO) (Molecular Probes, #V22886) was used to label cynomolgus CDH19 positive CHO cells—as target cells and distinguish them from effector cells. Briefly, cells were harvested, washed once with PBS and adjusted to $10^6$ cell/mL in PBS containing 2% (v/v) FBS and the membrane dye DiO (5 µL/$10^6$ cells). After incubation for 3 min at 37° C., cells were washed twice in complete RPMI medium and the cell number adjusted to $1.25 \times 10^5$ cells/mL. The vitality of cells was determined using 0.5% (v/v) isotonic EosinG solution (Roth, #45380).

Flow Cytometry Based Analysis

This assay was designed to quantify the lysis of cynomolgus CDH19-transfected CHO cells in the presence of serial dilutions of CDH19 bispecific antibodies.

Equal volumes of DiO-labeled target cells and effector cells (i.e. CD3-expressing macaque T cell line 4119LnPx) were mixed, resulting in an E:T cell ratio of 10:1. 160 µL of this suspension were transferred to each well of a 96-well plate. 40 µL of serial dilutions of the CDH19 bispecific antibodies and a negative control bispecific (an CD3-based bispecific antibody recognizing an irrelevant target antigen) or RPMI complete medium as an additional negative control were added. The bispecific antibody-mediated cytotoxic reaction proceeded for 48 hours in a 7% $CO_2$ humidified incubator. Then cells were transferred to a new 96-well plate and loss of target cell membrane integrity was monitored by adding propidium iodide (PI) at a final concentration of 1 µg/mL. PI is a membrane impermeable dye that normally is excluded from viable cells, whereas dead cells take it up and become identifiable by fluorescent emission.

Samples were measured by flow cytometry on a FACSCanto II instrument and analyzed by FACSDiva software (both from Becton Dickinson).

Target cells were identified as DiO-positive cells. PI-negative target cells were classified as living target cells. Percentage of cytotoxicity was calculated according to the following formula:

$$\text{Cytotoxicity}[\%] = \frac{n_{dead\,target\,cells}}{n_{target\,cells}} \times 100$$

$n$ = number of events

Using GraphPad Prism 6 software (Graph Pad Software, San Diego), the percentage of cytotoxicity was plotted against the corresponding bispecific antibody concentrations. Dose response curves were analyzed with the four parametric logistic regression models for evaluation of sigmoid dose response curves with fixed hill slope and $EC_{50}$ values were calculated.

Figure 4:
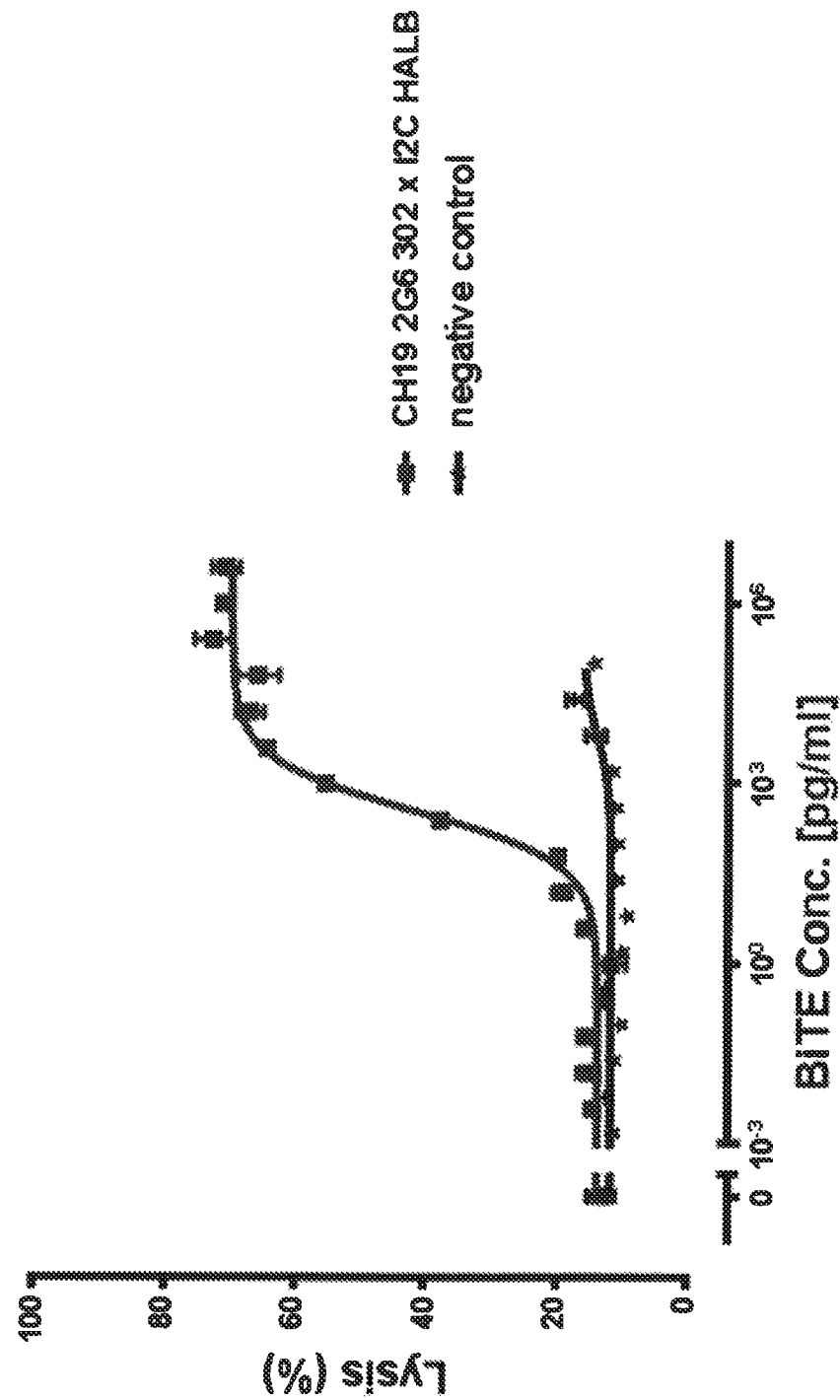
FIG. 4:
Cytotoxic activity of CDH19/CD3 bispecific antibodies as measured in a 48-hour FACS-based cytotoxicity assay. Effector cells: CD3-expressing macaque T cell line 4119LnPx. Target cells: cynomolgus CDH19-transfected CHO cells. Effector to target cell (E:T)-ratio: 10:1. The figure shows the results for CDH19 2G6 302×12C HALB and for a negative control.

The cytotox results using the above described system for CDH19 2G6 302×12C HALB and for a negative control are shown in FIG. 4

Example 4

Pharmacokinetics of BITE® Antibody Constructs

Four molecules named 1) 2G6-156; 2) 2G6-LFcBy; 3) 2G6-LFcBy-156; 4) 2G6-D3HSA were tested in the cynomolgus monkey in the context of a pharmacokinetic (PK) study. In this PK study a dose of 6 µg/kg was administered as a single intravenous bolus injection. For each of the above compounds, a group of 2 animals were used. Blood samples were collected and serum was prepared for determination of serum concentration for each drug in both animals. Serum drug levels were measured using an immunoassay. The serum concentration-time data were used to determine PK parameters. Blood sample was collected at the following time points: predose, 0.05, 0.25, 0.5, 1, 4, 8, 24, 48, 72, 168, 240, and 336 hours post dose. The PK parameters were determined using standard non-compartmental analysis (NCA) methods.

For all drugs tested, serum levels were quantifiable for the vast majority of time points in all animals after drug administration. The PK profiles showed a biphasic exponential decline for all drugs tested. Using NCA methods, the following parameters were estimated: $AUC_{inf}$ (Area under the serum concentration-time curve), $V_{ss}$ (volume of distribution at steady state), CL (systemic clearance), MRT (mean residence time), and Terminal $t_{1/2}$ (half-life estimated from terminal phase). The PK parameters (mean of n=2) of each compound tested are summarized below:

The $AUC_{inf}$ was 568 hr*ng/mL, 366 hr*ng/mL, 1796 hr*ng/mL, and 1383 hr*ng/mL respectively for compounds 1, 2, 3 and 4. The $V_{ss}$ was 446 mL/kg, 594 mL/kg, 193 mL/kg, and 80.7 mL/kg respectively for compounds 1, 2, 3 and 4. Systemic clearance was 11.3 mL/hr/kg, 16.1 mL/hr/kg, 4.3 mL/hr/kg, and 4.9 mL/hr/kg respectively for compounds 1, 2, 3 and 4. The MRT value for compounds 1, 2, 3 and 4 were 42.3 hr, 39.8 hr, 48.7 hr, and 18.1 hr respectively and that for terminal half-life was 44.3 hr, 31.2 hr, 40.3 hr, and 13.5 hr respectively for compounds 1, 2, 3 and 4.

The terminal half-life and MRT of each of compounds 1, 2 and 3 were much higher (>2-folds) than those for compound 4. Compounds 1, 2 and 3 present a longer half-life version of BiTE® antibody constructs.

Figure 5:
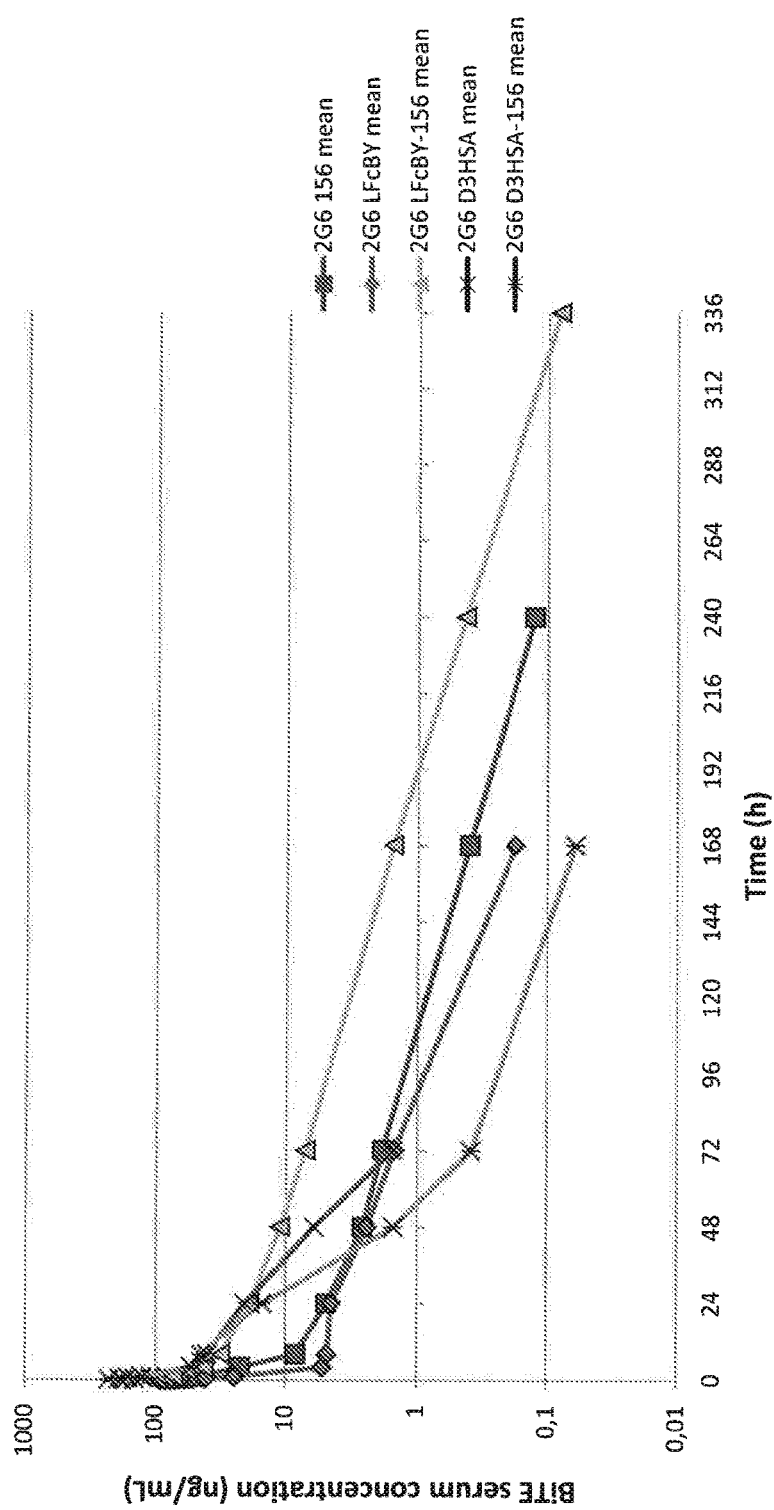
FIG. 5:
Pharmacokinetics of BiTE® antibody constructs
Four molecules named 1) 2G6-156; 2) 2G6-LFcBy; 3) 2G6-LFcBy-156; 4) 2G6-D3HSA were tested in the cynomolgus monkey in the context of a pharmacokinetic (PK) study. The figure shows the results in connection with Example 4.

Results see FIG. 5.

Example 5

Figure 8A:
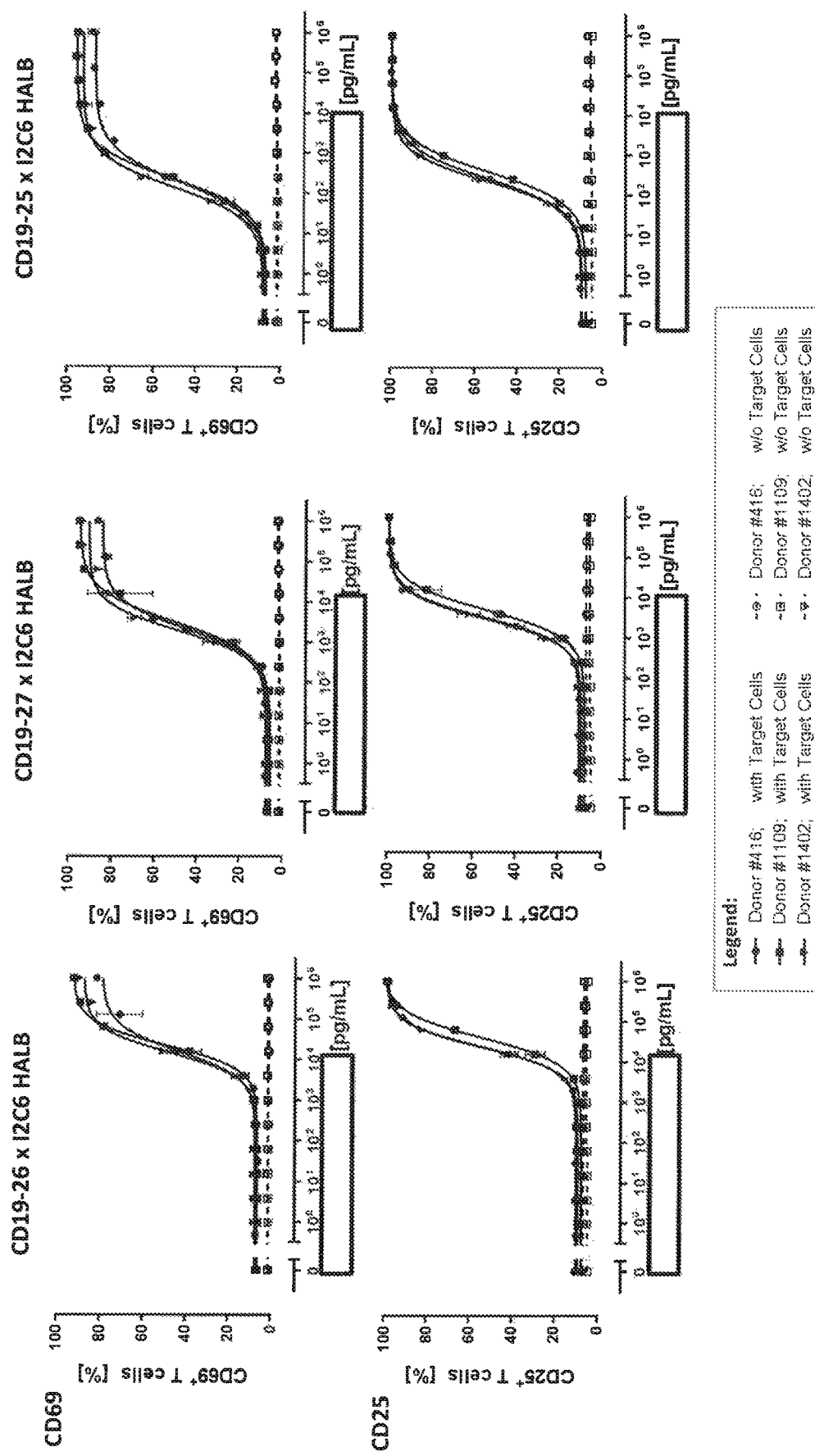
FIGS. 8A-8C:
T activation by bispecific antibody constructs binding to different cell surface target structures in absence and presence of target cells. Expression of CD25 and CD69 on T cells was determined by flow cytometry.
Figure 8B:
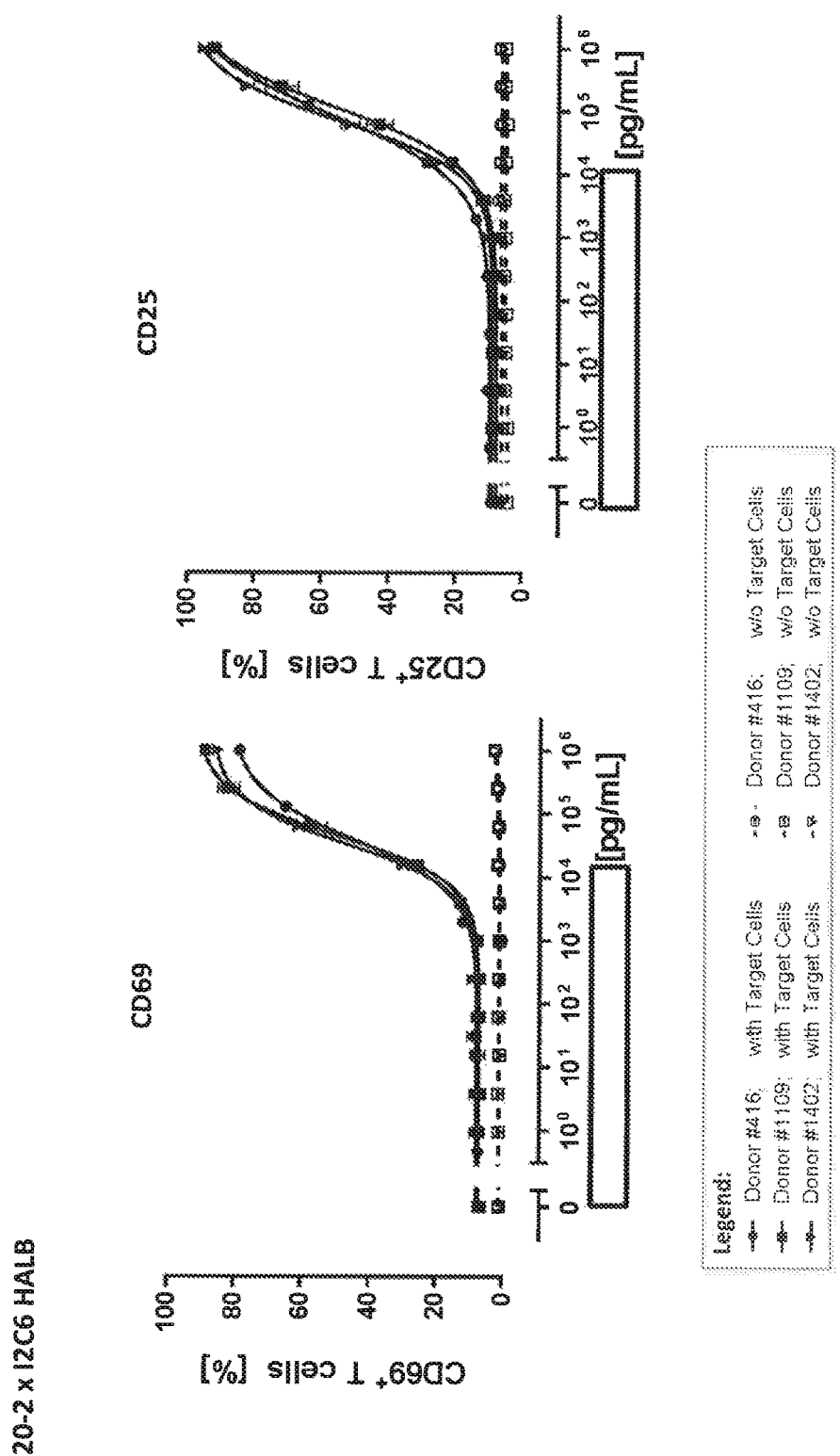

BiTE® Induced CD69 or CD25 Expression on T Cells in Presence and Absence of Target Cells Isolated T cells from healthy human donors were co-cultured in the presence or absence of target cells For CD19/CD3 and CD20/CD3 bispecific antibody constructs Raji cells were used as target cells. An E:T cell ratio of 10:1 was used and CD19-HALB-BITE (FIG. 8a) and CD20-HALB-BiTE (FIG. 8b) were incubated for 48 h. The expression of the activation markers CD69 or CD25 on T cells was determined by immunostaining and flow cytometry and antigen-specific conjugates mAb.

Figure 8C:
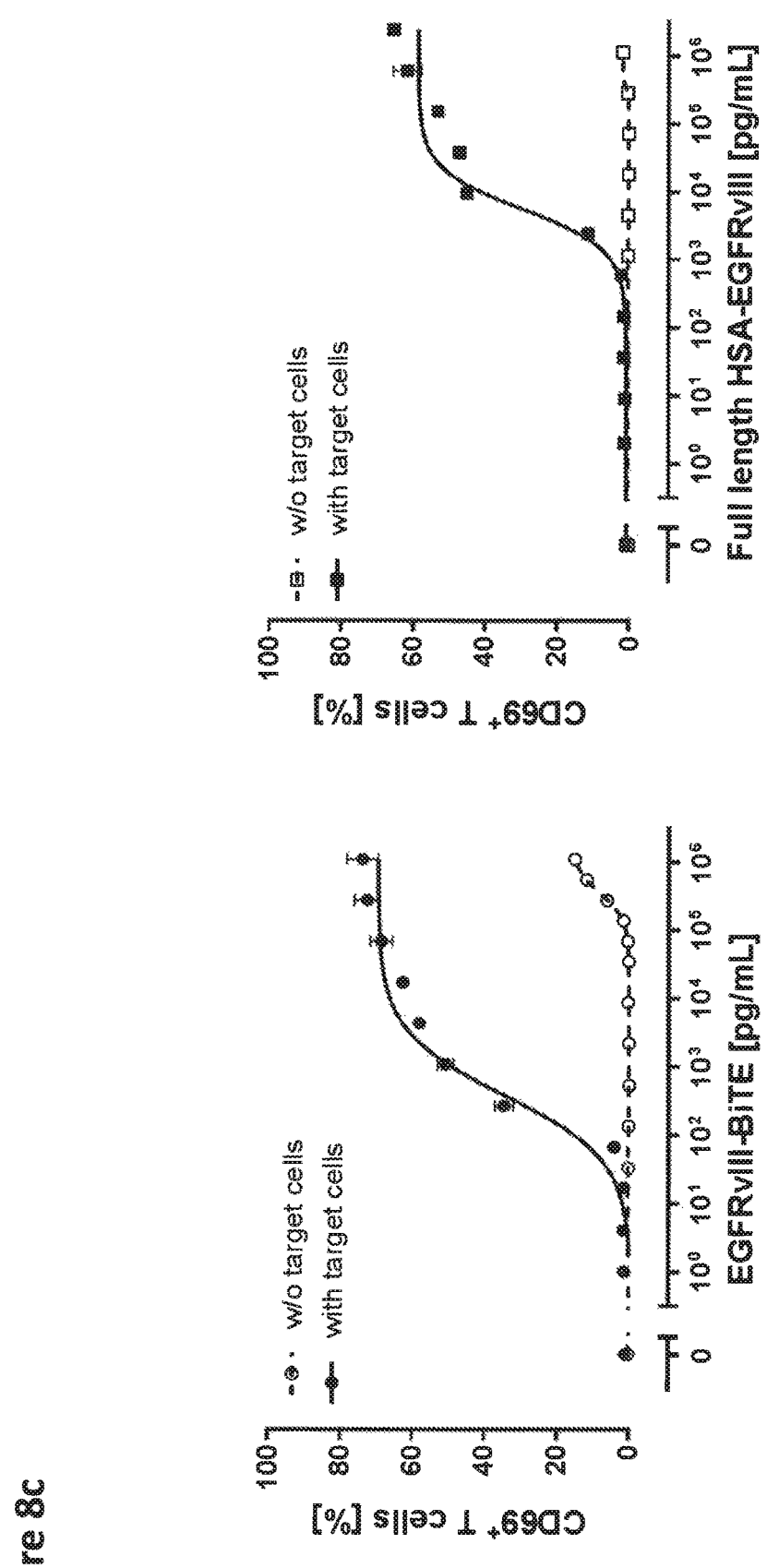

For EGFRvIII/CD3 bispecific antibody constructs U251vIII cells were used as target cells. At an E:T of 10:1 EGFRvIII-BiTE or the HSA-variant of the EGFRvIII-BITE were incubated for 48 h. The expression of the activation markers CD69 on T cells was determined by immunostaining and flow cytometry (FIG. 8c).

Example 6

Tumor-Accumulation of CDH19-HALB BITE

Figure 9:
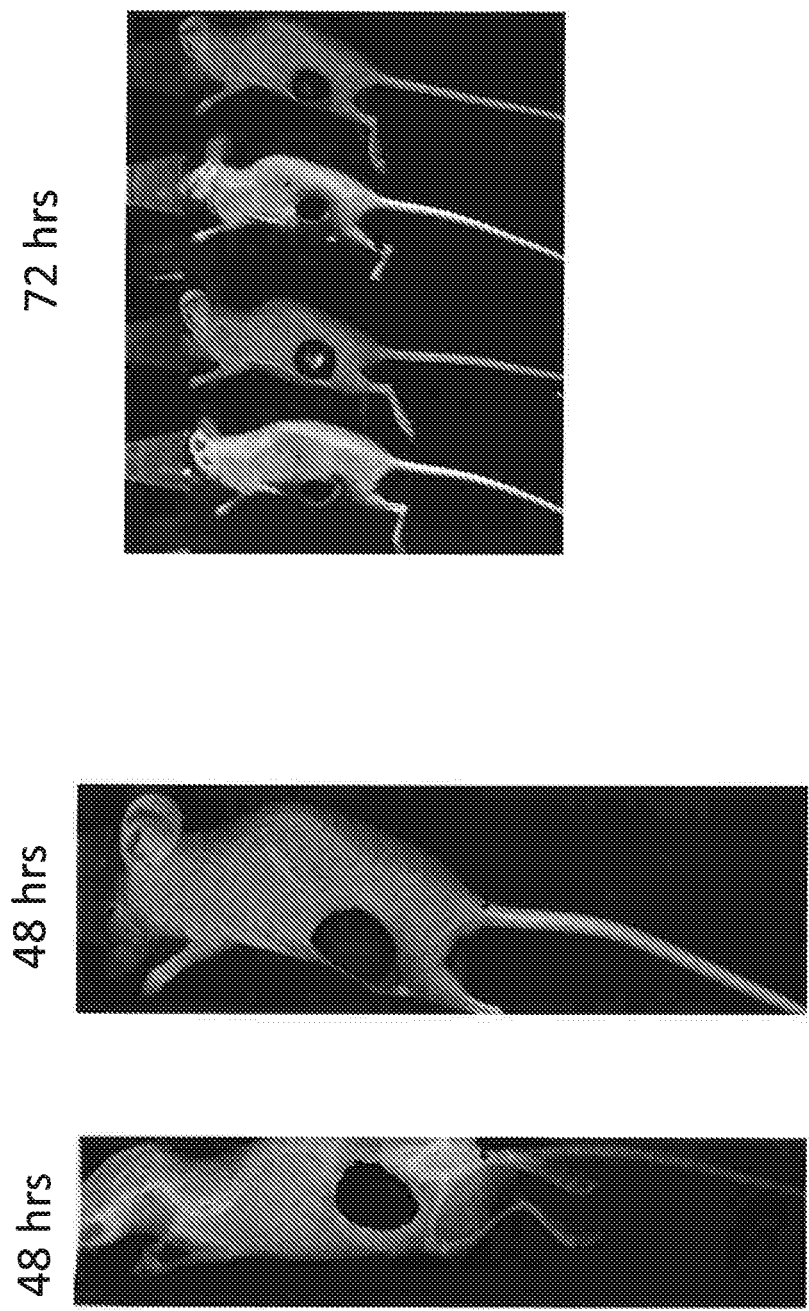
FIG. 9.

CDH19-HALB BiTE, labeled with CW800 (nearinfrared dye), injected i.v. into the lateral tail vein of tumor-bearing mice (CDH19-positive tumor), in vivo analysis using "In Vivo Xtreme Imager" (Bruker) at the indicated time post injection (FIG. 9).

Example 7

Pharmacokinetics of BiTE® Antibody Constructs after Single Administration

Different target binding BiTE® antibodies were fused to a single wild type human Albumin (HALB) moiety and were tested in the cynomolgus monkey in the context of pharmacokinetic (PK) studies. The pharmacokinetics of six BiTE®-HALB antibodies are shown exemplarily. The corresponding nomenclature of these molecules is briefly summarized in Table 2, below.

TABLE 2

Compound nomenclature of five single dosed BiTE ®-HALB antibodies

| compound synonym | test compound name |
| --- | --- |
| Compound 1 | MS-3 x I2C6-HALB |
| Compound 2 | MS-4 x I2C6-HALB |
| Compound 3 | MS-5 x I2C6-HALB |
| Compound 4 | CD33-1 x I2C6-HALB |
| Compound 5 | CDH19cc x I2C6-HALB |
| Compound 6 | CDH19 x I2C6-HALB |

The BiTE®-HALB antibodies were administered as intravenous short (30 min) infusions at 12 μg/kg (compounds 1-3 and 5) and 15 μg/kg (compounds 4 and 6), respectively. For each of the above named compounds a group of three animals was used. Blood samples were collected and serum was prepared for determination of serum concentrations. Serum BiTE® antibody construct levels were measured using an immunoassay. The assay is performed by capturing the BiTE® via its target moiety, while an antibody directed against the CD3-binding part of the construct was used for detection. The serum concentration-time profiles were used to determine PK parameters. Blood sampling time points are listed in Table 3 below.

TABLE 3

Blood sampling time points during the PK study

| blood sampling time points cmpd. 1-3 [h] | blood sampling time points cmpd. 4-5 [h] | blood sampling time points cmpd. 6 [h] |
| --- | --- | --- |
| 0 | 0 | 0 |
| 0.05 | 0.08 | 0.08 |
| 0.25 | 0.25 | 0.25 |
| 0.5 | 1 | 1 |
| 1 | 4 | 2 |
| 4 | 8 | 4 |
| 8 | 16 | 8 |
| 24 | 24 | 24 |
| 48 | 48 | 48 |
| 72 | 72 | 72 |
| 168 | 120 | 96 |
| 240 | 168 | 168 |
| | 240 | 240 |

The pharmacokinetic parameters were determined using standard non-compartmental analysis (NCA) methods.

Figure 10:
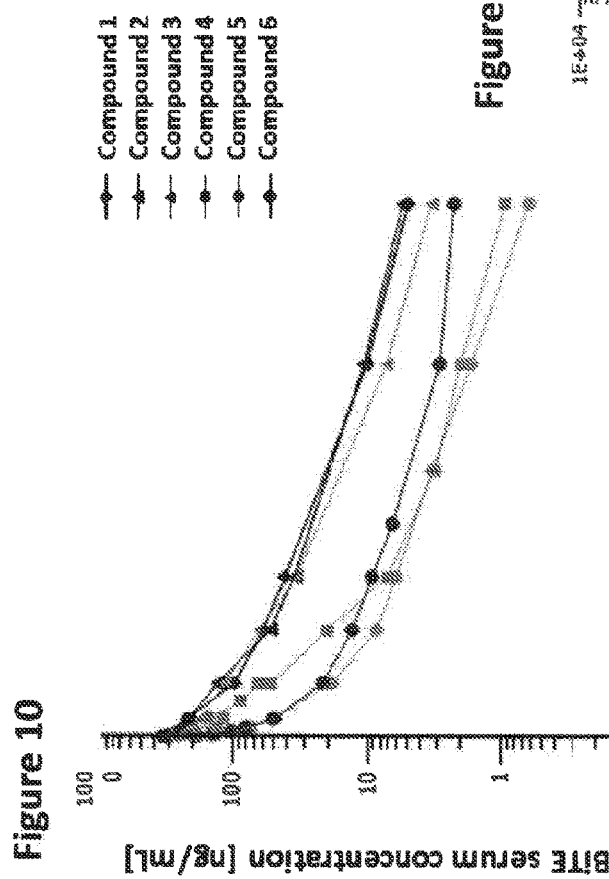

For all tested proteins serum levels were quantifiable for all time points in all animals after BiTE® antibody construct administration. The PK profiles describe a biphasic, exponential decline after each of the single test item administrations (FIG. 10).

Using non compartmental analysis, the following PK parameters were estimated: AUCinf (Area under the serum concentration—time curve), Vss (volume of distribution at steady state), CL (systemic clearance) and terminal t1/2 (terminal half-life).

The PK parameter as mean of n=3 for each tested compound are summarized in Table 4 below.

TABLE 4

Pharmacokinetic parameters after single dose administration of six various BiTE ®-HALB proteins in cynomolgus monkeys.

| test item | terminal t1/2 [h] | AUCinf [h*ng/mL] | Cl [mL/h/kg] | Vss [mL/kg] |
| --- | --- | --- | --- | --- |
| MS-3 x I2C6-HALB | 75 | 11419 | 1.1 | 66 |
| MS-4 x I2C6-HALB | 77 | 11593 | 1.0 | 65 |
| MS-5 x I2C6-HALB | 70 | 10262 | 1.2 | 64 |
| CD33-1 x I2C6-HALB | 48 | 4498 | 3.3 | 161 |
| CDH19cc x I2C6-HALB | 53 | 2226 | 6.7 | 303 |
| CDH19 x I2C6-HALB | 52 | 3199 | 3.8 | 349 |

The AUCinf for the different BiTE®-HALB variants ranged between 2226 h*ng/mL and 11593 h*ng/mL, depending on the BiTE® target context. All analyzed HALB fusions achieved terminal half-lives of at least 48 hours after single low dose administration at 12 and 15 μg/kg. Systemic clearance values were 1.1 mL/h/kg, 1.0 mL/h/kg, 1.2 mL/h/kg, 3.3 mL/h/kg, 6.7 mL/h/kg and 3.8 mL/h/kg respectively for compounds 1-6. The corresponding volume of distribution was 66 mL/kg, 65 mL/kg, 64 mL/kg, 161 mL/kg, 303 mL/kg and 349 mL/kg, respectively.

The differences in pharmacokinetic behavior of the various BiTE®-HALB antibodies was clearly related to the different BiTE® moieties and their targets, respectively. The HALB-moiety of each of the analyzed was represented by the wild type human Albumin and was not changed between the constructs.

Example 8

Pharmacokinetics of BITE® Antibody Constructs after Repeated Administration

Three molecules, CD33-1×I2C6-HALB (compound 4) and CD33-2×I2C6-HALB (compound 7) were tested in the cynomolgus monkey in the context of repeated dose pharmacokinetic (PK) studies. Each molecule represents a BiTE® moiety directed against one common target protein fused one copy of the wild type human serum albumin (HALB) moiety. Compound 8 represents a naked, non HALB-fused version of compound 7 and is named CD33-2×I2C6

The compounds were administered at different concentrations and in different dose schedules as described in Table 5 below.

TABLE 5

Administered doses with corresponding dose schedules analyzed in repeated dose set up of CD33-1 x I2C6 BiTE ® variants

| test item | Administered dose [µg/kg] | Dose schedule | Consecutive doses |
|---|---|---|---|
| CD33-1 x I2C6-HALB | 60<br>80<br>180 | Q2D (every other day) | 4 |
| CD33-2 x I2C6-HALB | 120 | Q3D (every third day) | 2 |
| | 120 | Q5D (every fifth day) | |
| CD33-2 x I2C6 | 30 µg/kg/day | cIV | 1 |

In these studies two or four consecutive doses of 60 µg/kg, 80 µg/kg, 180 µg/kg and 120 µg/kg were administered as intravenous short (30 min) infusions for compounds 4 and 7. Compound 8 was administered as continuous infusion (cIV) at 30 µg/kg/day for 7 days. For each of the above compounds a group of three animals were used. Blood samples were collected and serum was prepared for determination of serum concentrations. Serum BiTE® antibody construct levels were measured using an immunoassay. The assay is performed by capturing the BiTE® via its target moiety, while an antibody directed against the CD3-binding part of the construct was used for detection. The serum concentration-time profiles are described in FIG. 11.

Figure 11:
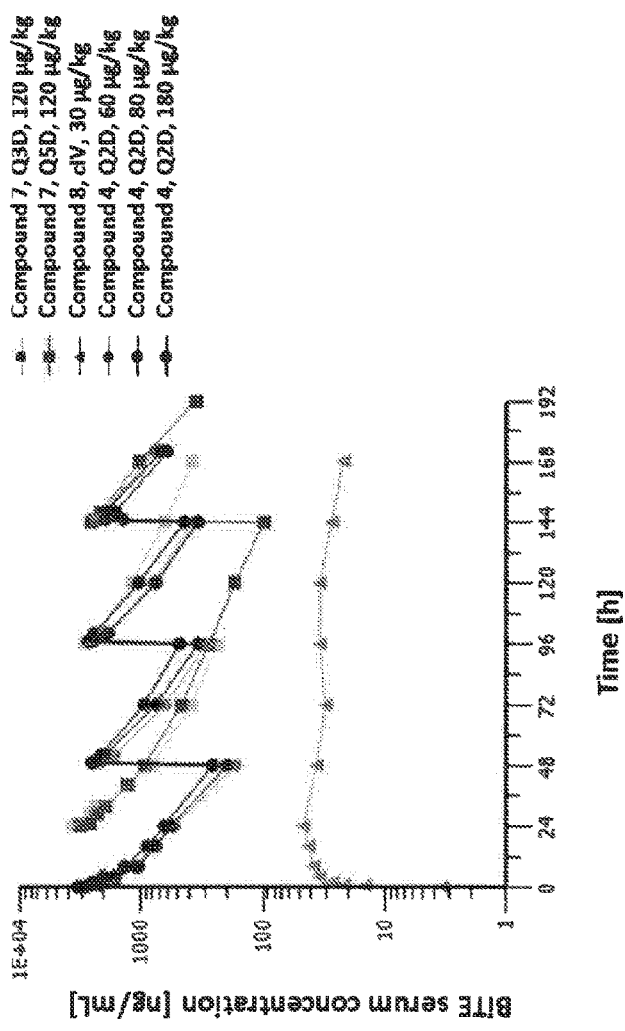

Repeated administration of BiTE®-HALB antibodies leads to accumulation of serum trough levels over dosing, whereas the maximum achieved serum concentrations (cmax) stays nearly stable over repeated dosing (Table 6Fehler! Verweisquelle konnte nicht gefunden werden.). For all described administered doses and dose schedules the exposures over 7 days of the CD33-1×I2C6-HALB compounds were clearly increased compared to the exposure of a single cIV administered CD33-1×I2C6 naked, BiTE® antibody construct within the same time frame (FIG. 11).

TABLE 6

Maximum and trough serum concentrations of CD33 x I2C6 BiTE ® antibody construct variations administered at different dose schedules and various doses

| test item | Dose [µg/kg] | Dose schedule | $C_{max}$ after dosing [ng/mL] | | | |
|---|---|---|---|---|---|---|
| | | | $1^{st}$ | $2^{nd}$ | $3^{rd}$ | $4^{th}$ |
| CD33-1 x I2C6-HALB | 60<br>80<br>180 | Q2D (every other day) | 1447<br>1961<br>5053 | 1092<br>1701<br>3871 | 1230<br>1691<br>4163 | 1214<br>1333<br>2171 |
| CD33-2 x I2C6-HALB | 120 | Q3D (every third day) | 3631 | 2891 | — | — |
| | | Q5D (every fifth day) | 3133 | 2630 | — | — |
| CD33-1 x I2C6-HALB | 60<br>80<br>180 | Q2D (every other day) | 84<br>132<br>394 | 147<br>229<br>735 | 190<br>231<br>676 | 395<br>412<br>1052 |

TABLE 6-continued

Maximum and trough serum concentrations of CD33 x I2C6 BiTE ® antibody construct variations administered at different dose schedules and various doses

| test item | Dose [µg/kg] | Dose schedule | $C_{max}$ after dosing [ng/mL] | | | |
|---|---|---|---|---|---|---|
| | | | $1^{st}$ | $2^{nd}$ | $3^{rd}$ | $4^{th}$ |
| CD33-2 x I2C6-HALB | 120 | Q3D (every third day) | 243 | 80 | — | — |
| | | Q5D (every fifth day) | 100 | 22 | — | — |

Every other day administration of compound 4 at different dose levels shows dose linear behavior with stable AUC/Dose values (Table 7Table) of the BiTE®-HALB antibody construct in a dose range of 60 µg/kg to 180 µg/kg.

TABLE 7

Exposure over dose of CD33-1 x I2C6-HALB BiTE ® antibodies administered at 60, 80 and 180 µg/kg compared to canonical CD33-2 x I2C6 BiTE ®

| test item | Administered dose [µg/kg] | $AUC_{0-168h}$/Dose |
|---|---|---|
| CD33-1 x I2C6-HALB | 60 | 0.341 |
| | 80 | 0.341 |
| | 180 | 0.416 |
| CD33-2 x I2C6 | 30 µg/kg/day | 0.027 |

The mean AUC/Dose of the CD33-1×I2C6-HALB BITE® antibody construct is 10-fold increased, compared to the AUC/Dose of the corresponding canonical BiTE® antibody construct.

Example 9

Pharmacokinetics of BiTE® Antibody Constructs with Different Albumin-Based Half-Life Extensions Eight molecules were tested in the cynomolgus monkey in the context of a pharmacokinetic (PK) study. Each molecule represents a fusion of the same BiTE® protein to wild type or FcRn-affinity modified human serum albumin (HALB). The names of the test compounds are briefly summarized in Table 8, below.

TABLE 8

| Compound nomenclature | |
|---|---|
| compound synonym | test compound name |
| Compound 9 | EvIII-1 x I2C6-HALB |
| Compound 10 | EvIII-1 x I2C6-HALB098 |
| Compound 11 | EvIII-1 x I2C6-HALB114 |
| Compound 12 | EvIII-1 x I2C6-HALB131 |
| Compound 13 | EvIII-1 x I2C6-HALB133 |
| Compound 14 | EvIII-1 x I2C6-HALB135 |
| Compound 15 | EvIII-1 x I2C6-HALB253 |
| Compound 16 | EvIII-1 x I2C6-HALB254 |

In this study two consecutive doses of 80 µg/kg were administered as intravenous short (30 min) infusions. For each of the above compounds a group of three animals were used. Blood samples were collected and serum was prepared for determination of serum concentrations. Serum BiTE® antibody levels were measured using an immunoassay. The assay is performed by capturing the BiTE® via its target moiety, while an antibody directed against the CD3-binding part of the construct was used for detection. The serum concentration-time profiles were used to determine PK parameters. Blood sampling time points are listed in Table 9, below.

TABLE 9

Blood sampling time points during the PK study
blood sampling time points
[h]

| |
|---|
| 0.08 |
| 1 |
| 2 |
| 4 |
| 8 |
| 16 |
| 24 |
| 48 |
| 72 |
| 96 |
| 96 |

TABLE 9-continued

Blood sampling time points during the PK study
blood sampling time points
[h]

| |
|---|
| 97 |
| 100 |
| 120 |
| 144 |
| 168 |
| 192 |
| 216 |
| 240 |

Figure 12:
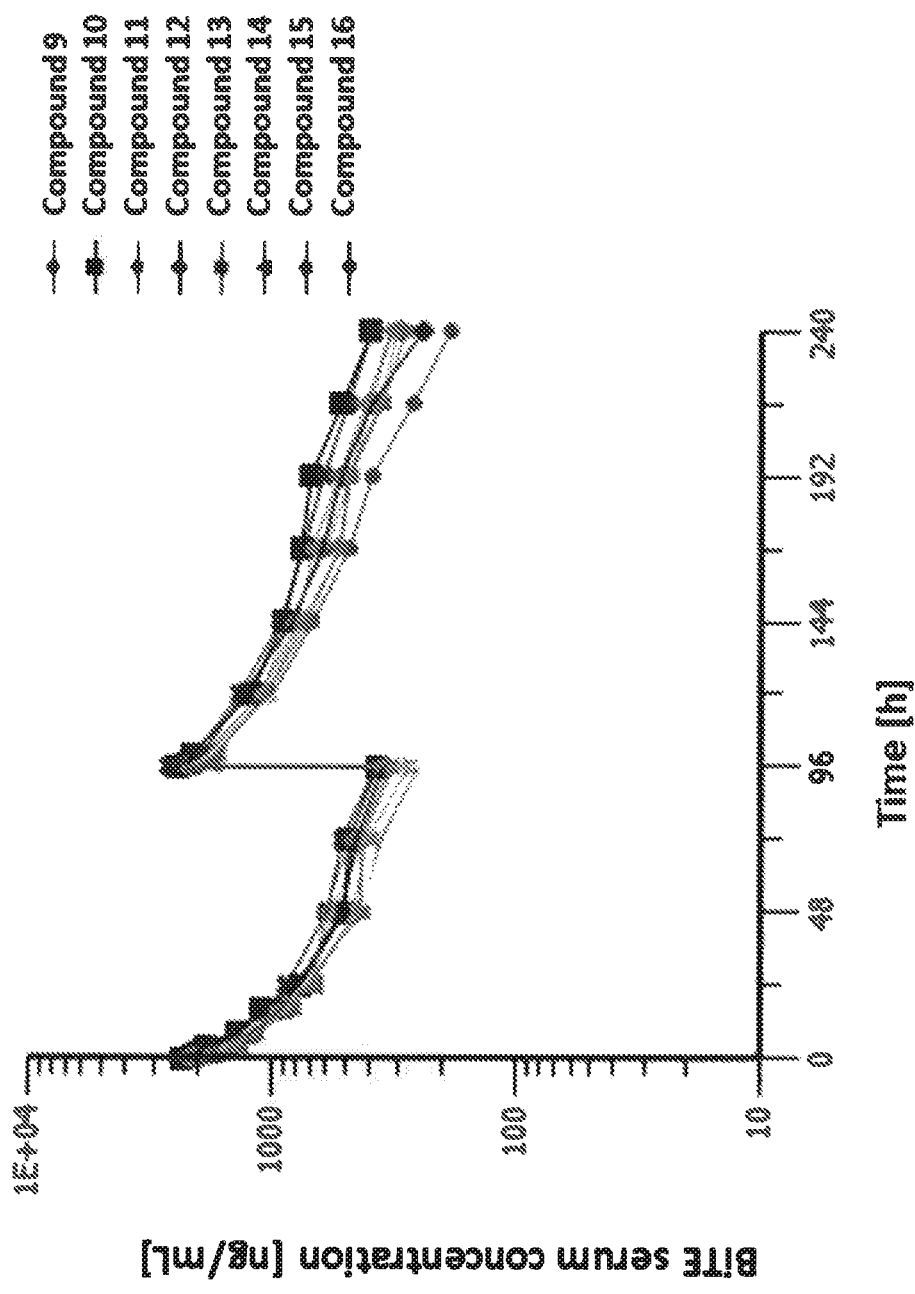

The pharmacokinetic parameters were determined using standard non-compartmental analysis (NCA) methods. The pharmacokinetic terminal phase of the single drugs was described using the decay period of the second test item administration. For all tested proteins serum levels were quantifiable for all time points in all animals after BiTE® antibody administration. The PK profiles describe a biphasic, exponential decline after each of the single test item administrations (FIG. 12).

Using non compartmental analysis, the following PK parameters were estimated: AUCinf (Area under the serum concentration—time curve), Vss (volume of distribution at steady state), CL (systemic clearance) and terminal t1/2 (terminal half-life). The PK parameter as mean of n=3 for each tested compound are summarized in the table below.

| test item | terminal t1/2 [h] | AUCinf [h*ng/mL] | Cl [mL/h/kg] | Vss [mL/kg] | x-fold increase in t1/2 compared to EGFRvIII-HALB |
|---|---|---|---|---|---|
| EvIII-1 x I2C6-HALB | 51.2 | 169109 | 0.95 | 110.21 | 1 |
| EvIII-1 x I2C6-HALB098 | 67.6 | 208504 | 0.77 | 109.03 | 1.32 |
| EvIII-1 x I2C6-HALB114 | 79.7 | 248438 | 0.64 | 99.87 | 1.56 |
| EvIII-1 x I2C6-HALB131 | 69.8 | 194542 | 0.82 | 118.34 | 1.36 |
| EvIII-1 x I2C6-HALB133 | 54.2 | 203041 | 0.79 | 98.35 | 1.06 |
| EvIII-1 x I2C6-HALB135 | 71.1 | 246928 | 0.65 | 95.05 | 1.39 |
| EvIII-1 x I2C6-HALB253 | 71.2 | 216000 | 0.74 | 106.44 | 1.39 |
| EvIII-1 x I2C6-HALB254 | 66.8 | 189131 | 0.85 | 117.72 | 1.30 |

In respect to terminal half-life, all tested affinity-increased EGFRvIII-HALB variants achieve a factor of up to 1.56 fold (compound 11) longer half-life then the wild-type HALB fusion protein in the cyno repeated dose setting. They thereby all represent a half-life extended (HLE) version of the corresponding wild-type albumin.

Lengthy table referenced here

US11661462-20230530-T00001

Please refer to the end of the specification for access instructions.

Lengthy table referenced here

US11661462-20230530-T00002

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US11661462B2). An electronic copy of the table will also be available from the USPTO upon request and payment of the fee set forth in 37 CFR 1.19(b)(3).

SEQUENCE LISTING (2709 sequences)

SEQ ID NO: 1 - protein, 5 aa, Artificial Sequence
  Synthetic polypeptide
QDGNE

SEQ ID NO: 2 - protein, 1100 aa, Artificial Sequence [sequence omitted]

SEQ ID NO: 3 - protein, 1100 aa, Artificial Sequence
  Synthetic polypeptide
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLDYHHHHHH

SEQ ID NO: 4 - protein, 585 aa, Artificial Sequence [sequence omitted]

SEQ ID NO: 5 - protein, 585 aa, Artificial Sequence
  Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 6 - protein, 585 aa, Artificial Sequence
  Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 7 - protein, 585 aa, Artificial Sequence
  Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 8 - protein, 585 aa, Artificial Sequence
  Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 9 - protein, 585 aa, Artificial Sequence
  Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 10 - protein, 585 aa, Artificial Sequence
  Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 11 - protein, 585 aa, Artificial Sequence
  Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 12 - protein, 585 aa, Artificial Sequence
  Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 13 - protein, 5 aa, Artificial Sequence
  Synthetic polypeptide
GGGGS

SEQ ID NO: 14 - protein, 14 aa, Artificial Sequence
  Synthetic polypeptide
GSSTGAVTSGYYPN

SEQ ID NO: 15 - protein, 7 aa, Artificial Sequence
  Synthetic polypeptide
GTKFLAP

SEQ ID NO: 16 - protein, 9 aa, Artificial Sequence
  Synthetic polypeptide
ALWYSNRWV

SEQ ID NO: 17 - protein, 5 aa, Artificial Sequence
  Synthetic polypeptide
IYAMN

SEQ ID NO: 18 - protein, 19 aa, Artificial Sequence
  Synthetic polypeptide
RIRSKYNNYATYYADSVKS

SEQ ID NO: 19 - protein, 14 aa, Artificial Sequence
  Synthetic polypeptide
HGNFGNSYVSFFAY

SEQ ID NO: 20 - protein, 125 aa, Artificial Sequence
  Synthetic polypeptide
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 21 - DNA, 375 bp, Artificial Sequence
  Synthetic polynucleotide
gaggtgcagctggtcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctca

SEQ ID NO: 22 - protein, 109 aa, Artificial Sequence
  Synthetic polypeptide
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 23 - DNA, 327 bp, Artificial Sequence
  Synthetic polynucleotide
cagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 24 - protein, 249 aa, Artificial Sequence
  Synthetic polypeptide
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 25 - DNA, 747 bp, Artificial Sequence
  Synthetic polynucleotide
gaggtgcagctggtcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 26 - protein, 14 aa, Artificial Sequence
  Synthetic polypeptide
GSSTGAVTSGYYPN

SEQ ID NO: 27 - protein, 7 aa, Artificial Sequence
  Synthetic polypeptide
GTKFLAP

SEQ ID NO: 28 - protein, 9 aa, Artificial Sequence
  Synthetic polypeptide
ALWYSNRWV

SEQ ID NO: 29 - protein, 5 aa, Artificial Sequence
  Synthetic polypeptide
KYAMN

SEQ ID NO: 30 - protein, 19 aa, Artificial Sequence
  Synthetic polypeptide
RIRSKYNNYATYYADSVKD

SEQ ID NO: 31 - protein, 14 aa, Artificial Sequence
  Synthetic polypeptide
HGNFGNSYISYWAY

SEQ ID NO: 32 - protein, 125 aa, Artificial Sequence
  Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 33 - DNA, 375 bp, Artificial Sequence
  Synthetic polynucleotide
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctca

SEQ ID NO: 34 - protein, 109 aa, Artificial Sequence; identical to SEQ ID NO: 22
  Synthetic polypeptide

SEQ ID NO: 35 - DNA, 327 bp, Artificial Sequence; identical to SEQ ID NO: 23
  Synthetic polynucleotide

SEQ ID NO: 36 - protein, 249 aa, Artificial Sequence
  Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 37 - DNA, 747 bp, Artificial Sequence
  Synthetic polynucleotide
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 38 - protein, 14 aa, Artificial Sequence
  Synthetic polypeptide
GSSTGAVTSGYYPN

SEQ ID NO: 39 - protein, 7 aa, Artificial Sequence
  Synthetic polypeptide
GTKFLAP

SEQ ID NO: 40 - protein, 9 aa, Artificial Sequence
  Synthetic polypeptide
ALWYSNRWV

SEQ ID NO: 41 - protein, 5 aa, Artificial Sequence
  Synthetic polypeptide
SYAMN

SEQ ID NO: 42 - protein, 19 aa, Artificial Sequence
  Synthetic polypeptide
RIRSKYNNYATYYADSVKG

SEQ ID NO: 43 - protein, 14 aa, Artificial Sequence
  Synthetic polypeptide
HGNFGNSYLSFWAY

SEQ ID NO: 44 - protein, 125 aa, Artificial Sequence
  Synthetic polypeptide
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 45 - DNA, 374 bp, Artificial Sequence
  Synthetic polynucleotide
gaggtgcagctggtcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctc

SEQ ID NO: 46 - protein, 109 aa, Artificial Sequence; identical to SEQ ID NO: 22
  Synthetic polypeptide

SEQ ID NO: 47 - DNA, 327 bp, Artificial Sequence; identical to SEQ ID NO: 23
  Synthetic polynucleotide

SEQ ID NO: 48 - protein, 249 aa, Artificial Sequence
  Synthetic polypeptide
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 49 - DNA, 747 bp, Artificial Sequence
  Synthetic polynucleotide
gaggtgcagctggtcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 50 - protein, 14 aa, Artificial Sequence
  Synthetic polypeptide
GSSTGAVTSGYYPN

SEQ ID NO: 51 - protein, 7 aa, Artificial Sequence
  Synthetic polypeptide
GTKFLAP

SEQ ID NO: 52 - protein, 9 aa, Artificial Sequence
  Synthetic polypeptide
ALWYSNRWV

SEQ ID NO: 53 - protein, 5 aa, Artificial Sequence
  Synthetic polypeptide
RYAMN

SEQ ID NO: 54 - protein, 19 aa, Artificial Sequence
  Synthetic polypeptide
RIRSKYNNYATYYADSVKG

SEQ ID NO: 55 - protein, 14 aa, Artificial Sequence
  Synthetic polypeptide
HGNFGNSYLSYFAY

SEQ ID NO: 56 - protein, 125 aa, Artificial Sequence
  Synthetic polypeptide
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 57 - DNA, 375 bp, Artificial Sequence
  Synthetic polynucleotide
gaggtgcagctggtcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctca

SEQ ID NO: 58 - protein, 109 aa, Artificial Sequence; identical to SEQ ID NO: 22
  Synthetic polypeptide

SEQ ID NO: 59 - DNA, 327 bp, Artificial Sequence; identical to SEQ ID NO: 23
  Synthetic polynucleotide

SEQ ID NO: 60 - protein, 249 aa, Artificial Sequence
  Synthetic polypeptide
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 61 - DNA, 747 bp, Artificial Sequence
  Synthetic polynucleotide
gaggtgcagctggtcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 62 - protein, 14 aa, Artificial Sequence
  Synthetic polypeptide
RSSTGAVTSGYYPN

SEQ ID NO: 63 - protein, 7 aa, Artificial Sequence
  Synthetic polypeptide
ATDMRPS

SEQ ID NO: 64 - protein, 9 aa, Artificial Sequence
  Synthetic polypeptide
ALWYSNRWV

SEQ ID NO: 65 - protein, 5 aa, Artificial Sequence
  Synthetic polypeptide
VYAMN

SEQ ID NO: 66 - protein, 19 aa, Artificial Sequence
  Synthetic polypeptide
RIRSKYNNYATYYADSVKK

SEQ ID NO: 67 - protein, 14 aa, Artificial Sequence
  Synthetic polypeptide
HGNFGNSYLSWWAY

SEQ ID NO: 68 - protein, 125 aa, Artificial Sequence
  Synthetic polypeptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 69 - DNA, 375 bp, Artificial Sequence
  Synthetic polynucleotide
gaggtgcagctggtcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctca

SEQ ID NO: 70 - protein, 109 aa, Artificial Sequence
  Synthetic polypeptide
QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 71 - DNA, 327 bp, Artificial Sequence
  Synthetic polynucleotide
cagactgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 72 - protein, 249 aa, Artificial Sequence
  Synthetic polypeptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 73 - DNA, 747 bp, Artificial Sequence
  Synthetic polynucleotide
gaggtgcagctggtcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 74 - protein, 14 aa, Artificial Sequence
  Synthetic polypeptide
GSSTGAVTSGYYPN

SEQ ID NO: 75 - protein, 7 aa, Artificial Sequence
  Synthetic polypeptide
GTKFLAP

SEQ ID NO: 76 - protein, 9 aa, Artificial Sequence
  Synthetic polypeptide
ALWYSNRWV

SEQ ID NO: 77 - protein, 5 aa, Artificial Sequence
  Synthetic polypeptide
KYAMN

SEQ ID NO: 78 - protein, 19 aa, Artificial Sequence
  Synthetic polypeptide
RIRSKYNNYATYYADSVKS

SEQ ID NO: 79 - protein, 14 aa, Artificial Sequence
  Synthetic polypeptide
HGNFGNSYTSYYAY

SEQ ID NO: 80 - protein, 125 aa, Artificial Sequence
  Synthetic polypeptide
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 81 - DNA, 375 bp, Artificial Sequence
  Synthetic polynucleotide
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctca

SEQ ID NO: 82 - protein, 109 aa, Artificial Sequence; identical to SEQ ID NO: 22
  Synthetic polypeptide

SEQ ID NO: 83 - DNA, 327 bp, Artificial Sequence; identical to SEQ ID NO: 23
  Synthetic polynucleotide

SEQ ID NO: 84 - protein, 249 aa, Artificial Sequence
  Synthetic polypeptide
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 85 - DNA, 747 bp, Artificial Sequence
  Synthetic polynucleotide
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 86 - protein, 14 aa, Artificial Sequence
  Synthetic polypeptide
RSSTGAVTSGYYPN

SEQ ID NO: 87 - protein, 7 aa, Artificial Sequence
  Synthetic polypeptide
ATDMRPS

SEQ ID NO: 88 - protein, 9 aa, Artificial Sequence
  Synthetic polypeptide
ALWYSNRWV

SEQ ID NO: 89 - protein, 5 aa, Artificial Sequence
  Synthetic polypeptide
GYAMN

SEQ ID NO: 90 - protein, 19 aa, Artificial Sequence
  Synthetic polypeptide
RIRSKYNNYATYYADSVKE

SEQ ID NO: 91 - protein, 14 aa, Artificial Sequence
  Synthetic polypeptide
HRNFGNSYLSWFAY

SEQ ID NO: 92 - protein, 125 aa, Artificial Sequence
  Synthetic polypeptide
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 93 - DNA, 375 bp, Artificial Sequence
  Synthetic polynucleotide
gaggtgcagctggtcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctca

SEQ ID NO: 94 - protein, 109 aa, Artificial Sequence; identical to SEQ ID NO: 70
  Synthetic polypeptide

SEQ ID NO: 95 - DNA, 327 bp, Artificial Sequence; identical to SEQ ID NO: 71
  Synthetic polynucleotide

SEQ ID NO: 96 - protein, 249 aa, Artificial Sequence
  Synthetic polypeptide
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 97 - DNA, 747 bp, Artificial Sequence
  Synthetic polynucleotide
gaggtgcagctggtcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 98 - protein, 14 aa, Artificial Sequence
  Synthetic polypeptide
GSSTGAVTSGYYPN

SEQ ID NO: 99 - protein, 7 aa, Artificial Sequence
  Synthetic polypeptide
GTKFLAP

SEQ ID NO: 100 - protein, 9 aa, Artificial Sequence
  Synthetic polypeptide
ALWYSNRWV

SEQ ID NO: 101 - protein, 5 aa, Artificial Sequence
  Synthetic polypeptide
VYAMN

SEQ ID NO: 102 - protein, 19 aa, Artificial Sequence
  Synthetic polypeptide
RIRSKYNNYATYYADSVKK

SEQ ID NO: 103 - protein, 14 aa, Artificial Sequence
  Synthetic polypeptide
HGNFGNSYISWWAY

SEQ ID NO: 104 - protein, 125 aa, Artificial Sequence
  Synthetic polypeptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 105 - DNA, 375 bp, Artificial Sequence
  Synthetic polynucleotide
gaggtgcagctggtcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctca

SEQ ID NO: 106 - protein, 109 aa, Artificial Sequence; identical to SEQ ID NO: 22
  Synthetic polypeptide

SEQ ID NO: 107 - DNA, 327 bp, Artificial Sequence; identical to SEQ ID NO: 23
  Synthetic polynucleotide

SEQ ID NO: 108 - protein, 249 aa, Artificial Sequence
  Synthetic polypeptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 109 - DNA, 747 bp, Artificial Sequence
  Synthetic polynucleotide
gaggtgcagctggtcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 110 - protein, 14 aa, Artificial Sequence
  Synthetic polypeptide
GSSTGAVTSGNYPN

SEQ ID NO: 111 - protein, 7 aa, Artificial Sequence
  Synthetic polypeptide
GTKFLAP

SEQ ID NO: 112 - protein, 9 aa, Artificial Sequence
  Synthetic polypeptide
VLWYSNRWV

SEQ ID NO: 113 - protein, 5 aa, Artificial Sequence
  Synthetic polypeptide
SYAMN

SEQ ID NO: 114 - protein, 19 aa, Artificial Sequence
  Synthetic polypeptide
RIRSKYNNYATYYADSVKG

SEQ ID NO: 115 - protein, 14 aa, Artificial Sequence
  Synthetic polypeptide
HGNFGNSYVSWWAY

SEQ ID NO: 116 - protein, 125 aa, Artificial Sequence
  Synthetic polypeptide
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 117 - DNA, 375 bp, Artificial Sequence
  Synthetic polynucleotide
gaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctca

SEQ ID NO: 118 - protein, 109 aa, Artificial Sequence
  Synthetic polypeptide
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 119 - DNA, 327 bp, Artificial Sequence
  Synthetic polynucleotide
cagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 120 - protein, 249 aa, Artificial Sequence
  Synthetic polypeptide
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 121 - DNA, 747 bp, Artificial Sequence
  Synthetic polynucleotide
gaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 122 - protein, 14 aa, Artificial Sequence
  Synthetic polypeptide
GSSTGAVTSGNYPN

SEQ ID NO: 123 - protein, 7 aa, Artificial Sequence
  Synthetic polypeptide
GTKFLAP

SEQ ID NO: 124 - protein, 9 aa, Artificial Sequence
  Synthetic polypeptide
VLWYSNRWV

SEQ ID NO: 125 - protein, 5 aa, Artificial Sequence
  Synthetic polypeptide
KYAMN

SEQ ID NO: 126 - protein, 19 aa, Artificial Sequence
  Synthetic polypeptide
RIRSKYNNYATYYADSVKD

SEQ ID NO: 127 - protein, 14 aa, Artificial Sequence
  Synthetic polypeptide
HGNFGNSYISYWAY

SEQ ID NO: 128 - protein, 125 aa, Artificial Sequence; identical to SEQ ID NO: 32
  Synthetic polypeptide

SEQ ID NO: 129 - DNA, 375 bp, Artificial Sequence; identical to SEQ ID NO: 33
  Synthetic polynucleotide

SEQ ID NO: 130 - protein, 109 aa, Artificial Sequence; identical to SEQ ID NO: 118
  Synthetic polypeptide

SEQ ID NO: 131 - DNA, 327 bp, Artificial Sequence; identical to SEQ ID NO: 119
  Synthetic polynucleotide

SEQ ID NO: 132 - protein, 249 aa, Artificial Sequence
  Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 133 - DNA, 747 bp, Artificial Sequence
  Synthetic polynucleotide
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 134 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 135 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 136 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 137 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 138 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 139 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 140 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 141 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 142 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 143 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 144 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 145 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 146 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 147 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 148 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 149 - protein, 1094 aa, Artificial Sequence; identical to SEQ ID NO: 144
  Synthetic polypeptide

SEQ ID NO: 150 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 151 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 152 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 153 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 154 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 155 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 156 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 157 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 158 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 159 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 160 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 161 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 162 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 163 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 164 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 165 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 166 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 167 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 168 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 169 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 170 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 171 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 172 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 173 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 174 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 175 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 176 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 177 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 178 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 179 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 180 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 181 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 182 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 183 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 184 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 185 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 186 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 187 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 188 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 189 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 190 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 191 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 192 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 193 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 194 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 195 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 196 - protein, 1094 aa, Artificial Sequence; identical to SEQ ID NO: 191
  Synthetic polypeptide

SEQ ID NO: 197 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 198 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 199 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 200 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 201 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 202 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 203 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 204 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 205 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 206 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 207 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 208 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 209 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 210 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 211 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 212 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 213 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 214 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 215 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 216 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 217 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 218 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 219 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 220 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 221 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 222 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 223 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 224 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 225 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 226 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 227 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 228 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 229 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 230 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 231 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 232 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 233 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 234 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 235 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 236 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 237 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 238 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 239 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 240 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 241 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 242 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 243 - protein, 1094 aa, Artificial Sequence; identical to SEQ ID NO: 238
  Synthetic polypeptide

SEQ ID NO: 244 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 245 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 246 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 247 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 248 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 249 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 250 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 251 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 252 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 253 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 254 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 255 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 256 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 257 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 258 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 259 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 260 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 261 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 262 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 263 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 264 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 265 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 266 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 267 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 268 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 269 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 270 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 271 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 272 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 273 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 274 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 275 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 276 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 277 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 278 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 279 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 280 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 281 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 282 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 283 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 284 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 285 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 286 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 287 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 288 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 289 - protein, 1095 aa, Artificial Sequence [sequence omitted]

SEQ ID NO: 290 - protein, 1094 aa, Artificial Sequence; identical to SEQ ID NO: 285
  Synthetic polypeptide

SEQ ID NO: 291 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 292 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 293 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 294 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 295 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 296 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 297 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 298 - protein, 1100 aa, Artificial Sequence [sequence omitted]

SEQ ID NO: 299 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 300 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 301 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 302 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 303 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 304 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 305 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 306 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 307 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 308 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 309 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 310 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 311 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 312 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 313 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 314 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 315 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 316 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 317 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 318 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 319 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 320 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 321 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 322 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 323 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 324 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 325 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 326 - protein, 1095 aa, Artificial Sequence [sequence omitted]

SEQ ID NO: 327 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 328 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 329 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 330 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 331 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 332 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 333 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 334 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 335 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 336 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 337 - protein, 1094 aa, Artificial Sequence; identical to SEQ ID NO: 332
  Synthetic polypeptide

SEQ ID NO: 338 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 339 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 340 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 341 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 342 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 343 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 344 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 345 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 346 - protein, 1094 aa, Artificial Sequence [sequence omitted]

SEQ ID NO: 347 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 348 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 349 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 350 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 351 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 352 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 353 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 354 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 355 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 356 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 357 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 358 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 359 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 360 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 361 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 362 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 363 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 364 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 365 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 366 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 367 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 368 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 369 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 370 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 371 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 372 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 373 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 374 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 375 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 376 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 377 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 378 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 379 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 380 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 381 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 382 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 383 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 384 - protein, 1094 aa, Artificial Sequence; identical to SEQ ID NO: 379
  Synthetic polypeptide

SEQ ID NO: 385 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 386 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 387 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 388 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 389 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 390 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 391 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 392 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 393 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 394 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 395 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 396 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 397 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 398 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 399 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 400 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 401 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 402 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 403 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 404 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 405 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 406 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 407 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 408 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 409 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 410 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 411 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 412 - protein, 1097 aa, Artificial Sequence [sequence omitted]

SEQ ID NO: 413 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 414 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 415 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 416 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 417 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 418 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 419 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 420 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 421 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 422 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 423 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 424 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 425 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 426 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 427 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 428 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 429 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 430 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 431 - protein, 1094 aa, Artificial Sequence; identical to SEQ ID NO: 426
  Synthetic polypeptide

SEQ ID NO: 432 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 433 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 434 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 435 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 436 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 437 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 438 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 439 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 440 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 441 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 442 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 443 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 444 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 445 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 446 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 447 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 448 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 449 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 450 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 451 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 452 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 453 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 454 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 455 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 456 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 457 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 458 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 459 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 460 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 461 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 462 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 463 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 464 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 465 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 466 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 467 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 468 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 469 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 470 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 471 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 472 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 473 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 474 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 475 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 476 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 477 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 478 - protein, 1094 aa, Artificial Sequence; identical to SEQ ID NO: 473
  Synthetic polypeptide

SEQ ID NO: 479 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 480 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 481 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 482 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 483 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 484 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 485 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 486 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 487 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 488 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 489 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 490 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 491 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 492 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 493 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 494 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 495 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 496 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 497 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 498 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 499 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 500 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 501 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 502 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 503 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 504 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 505 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 506 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 507 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 508 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 509 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 510 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 511 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 512 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 513 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 514 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 515 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 516 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 517 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 518 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 519 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 520 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 521 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 522 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 523 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 524 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 525 - protein, 1094 aa, Artificial Sequence; identical to SEQ ID NO: 520
  Synthetic polypeptide

SEQ ID NO: 526 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 527 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 528 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 529 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 530 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 531 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 532 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 533 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 534 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 535 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 536 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 537 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 538 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 539 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 540 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 541 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 542 - protein, 1095 aa, Artificial Sequence [sequence omitted]

SEQ ID NO: 543 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 544 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 545 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 546 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 547 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 548 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 549 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 550 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 551 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 552 - protein, 1100 aa, Artificial Sequence [sequence omitted]

SEQ ID NO: 553 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 554 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 555 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 556 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 557 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 558 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 559 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 560 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 561 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 562 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 563 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 564 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 565 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 566 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 567 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 568 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 569 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 570 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 571 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 572 - protein, 1094 aa, Artificial Sequence; identical to SEQ ID NO: 567
  Synthetic polypeptide

SEQ ID NO: 573 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 574 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 575 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 576 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 577 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 578 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 579 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 580 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 581 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 582 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 583 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 584 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 585 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 586 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 587 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 588 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 589 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 590 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 591 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 592 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 593 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 594 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 595 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 596 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 597 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 598 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 599 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 600 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 601 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 602 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 603 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 604 - protein, 27 aa, Homo sapiens
QDGNEEMGGITQTPYKVSISGTTVILT

SEQ ID NO: 605 - protein, 105 aa, Homo sapiens
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 606 - protein, 772 aa, Homo sapiens
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 607 - protein, 772 aa, Macaca fascicularis
MNCYLLLPFMLGIPLLWPCLGATENSQTKKVQQPVGSHLRVKRGWVWNQFFVPEEMNTTSHHVGRLRSDLDNGNNSFQYKLLGAGAGSTFIIDERTGDIYAIEKLDREERSLYILRAQVIDITTGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVNFEHQNHYGIRAKVKNHHVDEQLMKYHTEASTTFIKIQVEDVDEPPLFLLPYYIFEIFEETPQGSFVGVVSATDPDNRKSPIRYSITRSKVFNIDDNGTITTTNSLDREISAWYNLSITATEKYNIEQISSIPVYVQVLNINDHAPEFSQYYESYVCENAGSGQVIQTISAVDRDESIEEHHFYFNLSVEDTNSSSFTIIDNQDNTAVILTNRTGFNLQEEPIFYISILIADNGIPSLTSTNTLTIHVCDCDDSGSTQTCQYQELMLSMGFKTEVIIAILICIMVIFGFIFLTLGLKQRRKQILFPEKSEDFRENIFRYDDEGGGEEDTEAFDVAALRSSTIMRERKTRKTTSAEIRSLYRQSLQVGPDSAIFRKFILEKLEEADTDPCAPPFDSLQTYAFEGTGSLAGSLSSLESAVSDQDESYDYLNELGPRFKRLACMFGSAVQSNN

SEQ ID NO: 608 - protein, 585 aa, Artificial Sequence
  Synthetic polypeptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 609 - protein, 585 aa, Artificial Sequence
  Synthetic polypeptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 610 - protein, 585 aa, Artificial Sequence
  Synthetic polypeptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 611 - protein, 585 aa, Artificial Sequence
  Synthetic polypeptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 612 - protein, 585 aa, Artificial Sequence
  Synthetic polypeptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 613 - protein, 585 aa, Artificial Sequence
  Synthetic polypeptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 614 - protein, 585 aa, Artificial Sequence
  Synthetic polypeptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 615 - protein, 585 aa, Artificial Sequence
  Synthetic polypeptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 616 - protein, 585 aa, Artificial Sequence
  Synthetic polypeptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 617 - protein, 585 aa, Artificial Sequence
  Synthetic polypeptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 618 - protein, 585 aa, Artificial Sequence
  Synthetic polypeptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 619 - protein, 585 aa, Artificial Sequence
  Synthetic polypeptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 620 - protein, 585 aa, Artificial Sequence
  Synthetic polypeptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 621 - protein, 585 aa, Artificial Sequence
  Synthetic polypeptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 622 - protein, 585 aa, Artificial Sequence
  Synthetic polypeptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 623 - protein, 585 aa, Artificial Sequence
  Synthetic polypeptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 624 - protein, 585 aa, Artificial Sequence
  Synthetic polypeptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 625 - protein, 585 aa, Artificial Sequence
  Synthetic polypeptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 626 - protein, 585 aa, Artificial Sequence
  Synthetic polypeptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 627 - protein, 585 aa, Artificial Sequence
  Synthetic polypeptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 628 - protein, 585 aa, Artificial Sequence
  Synthetic polypeptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 629 - protein, 246 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 630 - protein, 243 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 631 - protein, 243 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIK

SEQ ID NO: 632 - protein, 243 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 633 - protein, 243 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 634 - protein, 243 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIK

SEQ ID NO: 635 - protein, 243 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 636 - protein, 242 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIK

SEQ ID NO: 637 - protein, 243 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 638 - protein, 242 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIK

SEQ ID NO: 639 - protein, 242 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIK

SEQ ID NO: 640 - protein, 242 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIK

SEQ ID NO: 641 - protein, 243 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 642 - protein, 242 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIK

SEQ ID NO: 643 - protein, 243 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIK

SEQ ID NO: 644 - protein, 242 aa, Artificial Sequence; identical to SEQ ID NO: 639
  Synthetic polypeptide

SEQ ID NO: 645 - protein, 243 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 646 - protein, 243 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 647 - protein, 243 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 648 - protein, 243 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 649 - protein, 243 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 650 - protein, 242 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIK

SEQ ID NO: 651 - protein, 243 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIK

SEQ ID NO: 652 - protein, 248 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIK

SEQ ID NO: 653 - protein, 242 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIK

SEQ ID NO: 654 - protein, 243 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIK

SEQ ID NO: 655 - protein, 243 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIK

SEQ ID NO: 656 - protein, 243 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIK

SEQ ID NO: 657 - protein, 243 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIK

SEQ ID NO: 658 - protein, 243 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIK

SEQ ID NO: 659 - protein, 243 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 660 - protein, 243 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIK

SEQ ID NO: 661 - protein, 243 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIK

SEQ ID NO: 662 - protein, 243 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIK

SEQ ID NO: 663 - protein, 243 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 664 - protein, 243 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 665 - protein, 243 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIK

SEQ ID NO: 666 - protein, 243 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 667 - protein, 243 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 668 - protein, 247 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIK

SEQ ID NO: 669 - protein, 248 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIK

SEQ ID NO: 670 - protein, 248 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIK

SEQ ID NO: 671 - protein, 248 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIK

SEQ ID NO: 672 - protein, 245 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIK

SEQ ID NO: 673 - protein, 246 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIK

SEQ ID NO: 674 - protein, 246 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIK

SEQ ID NO: 675 - protein, 246 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 676 - protein, 7 aa, Artificial Sequence
  Synthetic polypeptide
SSSYYWG

SEQ ID NO: 677 - protein, 16 aa, Artificial Sequence
  Synthetic polypeptide
SIYYSGITNYNPSLKS

SEQ ID NO: 678 - protein, 9 aa, Artificial Sequence
  Synthetic polypeptide
PSNYDAFDI

SEQ ID NO: 679 - protein, 14 aa, Artificial Sequence
  Synthetic polypeptide
TGSSSNIGAGYDVH

SEQ ID NO: 680 - protein, 7 aa, Artificial Sequence
  Synthetic polypeptide
GNSKRPS

SEQ ID NO: 681 - protein, 11 aa, Artificial Sequence
  Synthetic polypeptide
QSYDSSLGGWV

SEQ ID NO: 682 - protein, 119 aa, Artificial Sequence
  Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSS

SEQ ID NO: 683 - protein, 111 aa, Artificial Sequence
  Synthetic polypeptide
QSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGGGTKLTVL

SEQ ID NO: 684 - protein, 245 aa, Artificial Sequence
  Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSGGGGSGGGGSGGGGSQSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGGGTKLTVL

SEQ ID NO: 685 - protein, 500 aa, Artificial Sequence
  Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSGGGGSGGGGSGGGGSQSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 686 - protein, 5 aa, Artificial Sequence
  Synthetic polypeptide
DHYMS

SEQ ID NO: 687 - protein, 17 aa, Artificial Sequence
  Synthetic polypeptide
YISSSGSTIYYADSVKG

SEQ ID NO: 688 - protein, 8 aa, Artificial Sequence
  Synthetic polypeptide
DLGPSFDY

SEQ ID NO: 689 - protein, 11 aa, Artificial Sequence
  Synthetic polypeptide
RASQGISSWLA

SEQ ID NO: 690 - protein, 7 aa, Artificial Sequence
  Synthetic polypeptide
AASRLQS

SEQ ID NO: 691 - protein, 9 aa, Artificial Sequence
  Synthetic polypeptide
QQANSFPRT

SEQ ID NO: 692 - protein, 117 aa, Artificial Sequence
  Synthetic polypeptide
QVQLVESGGGVVQPGRSLRLSCAASGFTFSDHYMSWIRQTPGKGLEWVSYISSSGSTIYYADSVKGRFTISRDNAKNSLYLQMNSLRAEDTAVYYCARDLGPSFDYWGQGSLVTVSS

SEQ ID NO: 693 - protein, 107 aa, Artificial Sequence
  Synthetic polypeptide
DIQMTQSPSSVSASVGDRVTITCRASQGISSWLAWYQQKPGKAPKLLIDAASRLQSGVPSRFSGSGSGTDFTLTISSLQPEDFATYYCQQANSFPRTFGQGTKVEIK

SEQ ID NO: 694 - protein, 239 aa, Artificial Sequence
  Synthetic polypeptide
QVQLVESGGGVVQPGRSLRLSCAASGFTFSDHYMSWIRQTPGKGLEWVSYISSSGSTIYYADSVKGRFTISRDNAKNSLYLQMNSLRAEDTAVYYCARDLGPSFDYWGQGSLVTVSSGGGGSGGGGSGGGGSDIQMTQSPSSVSASVGDRVTITCRASQGISSWLAWYQQKPGKAPKLLIDAASRLQSGVPSRFSGSGSGTDFTLTISSLQPEDFATYYCQQANSFPRTFGQGTKVEIK

SEQ ID NO: 695 - protein, 494 aa, Artificial Sequence
  Synthetic polypeptide
QVQLVESGGGVVQPGRSLRLSCAASGFTFSDHYMSWIRQTPGKGLEWVSYISSSGSTIYYADSVKGRFTISRDNAKNSLYLQMNSLRAEDTAVYYCARDLGPSFDYWGQGSLVTVSSGGGGSGGGGSGGGGSDIQMTQSPSSVSASVGDRVTITCRASQGISSWLAWYQQKPGKAPKLLIDAASRLQSGVPSRFSGSGSGTDFTLTISSLQPEDFATYYCQQANSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 696 - protein, 5 aa, Artificial Sequence
  Synthetic polypeptide
DYYMT

SEQ ID NO: 697 - protein, 17 aa, Artificial Sequence
  Synthetic polypeptide
YISSSGSTIYYADSVKG

SEQ ID NO: 698 - protein, 8 aa, Artificial Sequence
  Synthetic polypeptide
DRNSHFDY

SEQ ID NO: 699 - protein, 11 aa, Artificial Sequence
  Synthetic polypeptide
RASQGITRWLA

SEQ ID NO: 700 - protein, 7 aa, Artificial Sequence
  Synthetic polypeptide
AASVLQS

SEQ ID NO: 701 - protein, 9 aa, Artificial Sequence
  Synthetic polypeptide
QQSNSFPRT

SEQ ID NO: 702 - protein, 117 aa, Artificial Sequence
  Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSS

SEQ ID NO: 703 - protein, 107 aa, Artificial Sequence
  Synthetic polypeptide
DIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIK

SEQ ID NO: 704 - protein, 239 aa, Artificial Sequence
  Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIK

SEQ ID NO: 705 - protein, 494 aa, Artificial Sequence
  Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 706 - protein, 5 aa, Artificial Sequence
  Synthetic polypeptide
DYYMT

SEQ ID NO: 707 - protein, 17 aa, Artificial Sequence
  Synthetic polypeptide
YISSSGSTIYYADSVKG

SEQ ID NO: 708 - protein, 8 aa, Artificial Sequence
  Synthetic polypeptide
DRNSHFDY

SEQ ID NO: 709 - protein, 11 aa, Artificial Sequence
  Synthetic polypeptide
RASQGINTWLA

SEQ ID NO: 710 - protein, 7 aa, Artificial Sequence
  Synthetic polypeptide
GASGLQS

SEQ ID NO: 711 - protein, 9 aa, Artificial Sequence
  Synthetic polypeptide
QQAKSFPRT

SEQ ID NO: 712 - protein, 117 aa, Artificial Sequence
  Synthetic polypeptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSS

SEQ ID NO: 713 - protein, 107 aa, Artificial Sequence
  Synthetic polypeptide
DIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIK

SEQ ID NO: 714 - protein, 239 aa, Artificial Sequence
  Synthetic polypeptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIK

SEQ ID NO: 715 - protein, 494 aa, Artificial Sequence
  Synthetic polypeptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 716 - protein, 5 aa, Artificial Sequence
  Synthetic polypeptide
DHYMS

SEQ ID NO: 717 - protein, 17 aa, Artificial Sequence
  Synthetic polypeptide
YISSSGGIIYYADSVKG

SEQ ID NO: 718 - protein, 8 aa, Artificial Sequence
  Synthetic polypeptide
DVGSHFDY

SEQ ID NO: 719 - protein, 11 aa, Artificial Sequence
  Synthetic polypeptide
RASQDISRWLA

SEQ ID NO: 720 - protein, 7 aa, Artificial Sequence
  Synthetic polypeptide
AASRLQS

SEQ ID NO: 721 - protein, 9 aa, Artificial Sequence
  Synthetic polypeptide
QQAKSFPRT

SEQ ID NO: 722 - protein, 117 aa, Artificial Sequence
  Synthetic polypeptide
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSS

SEQ ID NO: 723 - protein, 107 aa, Artificial Sequence
  Synthetic polypeptide
DIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIK

SEQ ID NO: 724 - protein, 239 aa, Artificial Sequence
  Synthetic polypeptide
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIK

SEQ ID NO: 725 - protein, 494 aa, Artificial Sequence
  Synthetic polypeptide
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 726 - protein, 5 aa, Artificial Sequence
  Synthetic polypeptide
DHYMS

SEQ ID NO: 727 - protein, 17 aa, Artificial Sequence
  Synthetic polypeptide
YISNSGSIIYYVDSVKG

SEQ ID NO: 728 - protein, 8 aa, Artificial Sequence
  Synthetic polypeptide
DVRTAFDY

SEQ ID NO: 729 - protein, 11 aa, Artificial Sequence
  Synthetic polypeptide
RASQSIGSWLA

SEQ ID NO: 730 - protein, 7 aa, Artificial Sequence
  Synthetic polypeptide
AASSLQS

SEQ ID NO: 731 - protein, 9 aa, Artificial Sequence
  Synthetic polypeptide
QQANSFPRT

SEQ ID NO: 732 - protein, 117 aa, Artificial Sequence
  Synthetic polypeptide
QVQLVESGGGLVKPGGSLRLSCAASGFTFSDHYMSWIRQAPGKGLEWISYISNSGSIIYYVDSVKGRFTISRDNAKNSLYLQMNSLRAEDTAVYYCARDVRTAFDYWGQGTLVTVSS

SEQ ID NO: 733 - protein, 107 aa, Artificial Sequence
  Synthetic polypeptide
DIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGQGTKVDIK

SEQ ID NO: 734 - protein, 239 aa, Artificial Sequence
  Synthetic polypeptide
QVQLVESGGGLVKPGGSLRLSCAASGFTFSDHYMSWIRQAPGKGLEWISYISNSGSIIYYVDSVKGRFTISRDNAKNSLYLQMNSLRAEDTAVYYCARDVRTAFDYWGQGTLVTVSSGGGGSGGGGSGGGGSDIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGQGTKVDIK

SEQ ID NO: 735 - protein, 494 aa, Artificial Sequence
  Synthetic polypeptide
QVQLVESGGGLVKPGGSLRLSCAASGFTFSDHYMSWIRQAPGKGLEWISYISNSGSIIYYVDSVKGRFTISRDNAKNSLYLQMNSLRAEDTAVYYCARDVRTAFDYWGQGTLVTVSSGGGGSGGGGSGGGGSDIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 736 - protein, 5 aa, Artificial Sequence
  Synthetic polypeptide
SKFMT

SEQ ID NO: 737 - protein, 16 aa, Artificial Sequence
  Synthetic polypeptide
VIYSGGKTYYADSVKG

SEQ ID NO: 738 - protein, 10 aa, Artificial Sequence
  Synthetic polypeptide
DSGGWGYFDY

SEQ ID NO: 739 - protein, 17 aa, Artificial Sequence
  Synthetic polypeptide
KSSQSVLYSSNNKNYLA

SEQ ID NO: 740 - protein, 7 aa, Artificial Sequence
  Synthetic polypeptide
WASTRES

SEQ ID NO: 741 - protein, 9 aa, Artificial Sequence
  Synthetic polypeptide
QQYYSTPPT

SEQ ID NO: 742 - protein, 118 aa, Artificial Sequence
  Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSS

SEQ ID NO: 743 - protein, 113 aa, Artificial Sequence
  Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIK

SEQ ID NO: 744 - protein, 246 aa, Artificial Sequence
  Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIK

SEQ ID NO: 745 - protein, 501 aa, Artificial Sequence
  Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 746 - protein, 5 aa, Artificial Sequence
  Synthetic polypeptide
SYYWN

SEQ ID NO: 747 - protein, 16 aa, Artificial Sequence
  Synthetic polypeptide
RIYYNGNTYYNPSLKS

SEQ ID NO: 748 - protein, 10 aa, Artificial Sequence
  Synthetic polypeptide
PKLGIDAFDI

SEQ ID NO: 749 - protein, 14 aa, Artificial Sequence
  Synthetic polypeptide
TGSSSNIGAGYDVH

SEQ ID NO: 750 - protein, 7 aa, Artificial Sequence
  Synthetic polypeptide
GNSNRPS

SEQ ID NO: 751 - protein, 11 aa, Artificial Sequence
  Synthetic polypeptide
QSYDSSLSGWV

SEQ ID NO: 752 - protein, 118 aa, Artificial Sequence
  Synthetic polypeptide
QVQLQESGPGLVKPSETLSLTCTVSGGSISSYYWNWIRQPPGKGLEWIGRIYYNGNTYYNPSLKSRVTISGDTSKNQFSLKLSSVTAADTAVYYCARPKLGIDAFDIWGQGTMVTVSS

SEQ ID NO: 753 - protein, 111 aa, Artificial Sequence
  Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVL

SEQ ID NO: 754 - protein, 244 aa, Artificial Sequence
  Synthetic polypeptide
QVQLQESGPGLVKPSETLSLTCTVSGGSISSYYWNWIRQPPGKGLEWIGRIYYNGNTYYNPSLKSRVTISGDTSKNQFSLKLSSVTAADTAVYYCARPKLGIDAFDIWGQGTMVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVL

SEQ ID NO: 755 - protein, 499 aa, Artificial Sequence
  Synthetic polypeptide
QVQLQESGPGLVKPSETLSLTCTVSGGSISSYYWNWIRQPPGKGLEWIGRIYYNGNTYYNPSLKSRVTISGDTSKNQFSLKLSSVTAADTAVYYCARPKLGIDAFDIWGQGTMVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 756 - protein, 5 aa, Artificial Sequence
  Synthetic polypeptide
SYGMH

SEQ ID NO: 757 - protein, 17 aa, Artificial Sequence
  Synthetic polypeptide
VISYHGRDTYYARSVKG

SEQ ID NO: 758 - protein, 15 aa, Artificial Sequence
  Synthetic polypeptide
DGATVTSYYYSGMDV

SEQ ID NO: 759 - protein, 11 aa, Artificial Sequence
  Synthetic polypeptide
RASQGISNYLA

SEQ ID NO: 760 - protein, 7 aa, Artificial Sequence
  Synthetic polypeptide
LASSLQS

SEQ ID NO: 761 - protein, 9 aa, Artificial Sequence
  Synthetic polypeptide
QQYNFYPFT

SEQ ID NO: 762 - protein, 125 aa, Artificial Sequence
  Synthetic polypeptide
QVQLVESGGGVVQPGRSLRLSCAASGFTFSSYGMHWVRQAPGKGLEWVAVISYHGRDTYYARSVKGRFTISRDNSKNTLYLHMNSLRAEDTAVYYCARDGATVTSYYYSGMDVWGQGTTVTVSSK

SEQ ID NO: 763 - protein, 107 aa, Artificial Sequence
  Synthetic polypeptide
DIQMTQSPSSLSASVGDRVTITCRASQGISNYLAWFQQKPGKAPKSLIYLASSLQSGVPSKFSGSGSGTDFTLTISSLQPEDFATYYCQQYNFYPFTFGPGTKVDIK

SEQ ID NO: 764 - protein, 246 aa, Artificial Sequence
  Synthetic polypeptide
QVQLVESGGGVVQPGRSLRLSCAASGFTFSSYGMHWVRQAPGKGLEWVAVISYHGRDTYYARSVKGRFTISRDNSKNTLYLHMNSLRAEDTAVYYCARDGATVTSYYYSGMDVWGQGTTVTVSSGGGGSGGGGSGGGGSDIQMTQSPSSLSASVGDRVTITCRASQGISNYLAWFQQKPGKAPKSLIYLASSLQSGVPSKFSGSGSGTDFTLTISSLQPEDFATYYCQQYNFYPFTFGPGTKVDIK

SEQ ID NO: 765 - protein, 501 aa, Artificial Sequence
  Synthetic polypeptide
QVQLVESGGGVVQPGRSLRLSCAASGFTFSSYGMHWVRQAPGKGLEWVAVISYHGRDTYYARSVKGRFTISRDNSKNTLYLHMNSLRAEDTAVYYCARDGATVTSYYYSGMDVWGQGTTVTVSSGGGGSGGGGSGGGGSDIQMTQSPSSLSASVGDRVTITCRASQGISNYLAWFQQKPGKAPKSLIYLASSLQSGVPSKFSGSGSGTDFTLTISSLQPEDFATYYCQQYNFYPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 766 - protein, 5 aa, Artificial Sequence
  Synthetic polypeptide
SYYWS

SEQ ID NO: 767 - protein, 16 aa, Artificial Sequence
  Synthetic polypeptide
YVYYSGTTNYNPSLKS

SEQ ID NO: 768 - protein, 10 aa, Artificial Sequence
  Synthetic polypeptide
IAVTGFYFDY

SEQ ID NO: 769 - protein, 12 aa, Artificial Sequence
  Synthetic polypeptide
RASQRVNNNYLA

SEQ ID NO: 770 - protein, 7 aa, Artificial Sequence
  Synthetic polypeptide
GASSRAT

SEQ ID NO: 771 - protein, 9 aa, Artificial Sequence
  Synthetic polypeptide
QQYDRSPLT

SEQ ID NO: 772 - protein, 118 aa, Artificial Sequence
  Synthetic polypeptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSS

SEQ ID NO: 773 - protein, 108 aa, Artificial Sequence
  Synthetic polypeptide
EIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIK

SEQ ID NO: 774 - protein, 241 aa, Artificial Sequence
  Synthetic polypeptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIK

SEQ ID NO: 775 - protein, 496 aa, Artificial Sequence
  Synthetic polypeptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 776 - protein, 5 aa, Artificial Sequence
  Synthetic polypeptide
SYYWS

SEQ ID NO: 777 - protein, 16 aa, Artificial Sequence
  Synthetic polypeptide
YIYYSGRTNYYPSLKS

SEQ ID NO: 778 - protein, 10 aa, Artificial Sequence
  Synthetic polypeptide
IAVAGFFFDY

SEQ ID NO: 779 - protein, 12 aa, Artificial Sequence
  Synthetic polypeptide
RASQSVNKNYLA

SEQ ID NO: 780 - protein, 7 aa, Artificial Sequence
  Synthetic polypeptide
GASSRAT

SEQ ID NO: 781 - protein, 9 aa, Artificial Sequence
  Synthetic polypeptide
QQYDRSPLT

SEQ ID NO: 782 - protein, 118 aa, Artificial Sequence
  Synthetic polypeptide
QVQLQESGPGLVKPSETLSLTCTVSGGSISSYYWSWIRQPPGKGLEWIGYIYYSGRTNYYPSLKSRVTISIDTSKNQFSLKLSSVTAADTAVYYCARIAVAGFFFDYWGQGTLVTVSS

SEQ ID NO: 783 - protein, 108 aa, Artificial Sequence
  Synthetic polypeptide
EIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKLEIK

SEQ ID NO: 784 - protein, 241 aa, Artificial Sequence
  Synthetic polypeptide
QVQLQESGPGLVKPSETLSLTCTVSGGSISSYYWSWIRQPPGKGLEWIGYIYYSGRTNYYPSLKSRVTISIDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKLEIK

SEQ ID NO: 785 - protein, 496 aa, Artificial Sequence
  Synthetic polypeptide
QVQLQESGPGLVKPSETLSLTCTVSGGSISSYYWSWIRQPPGKGLEWIGYIYYSGRTNYYPSLKSRVTISIDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 786 - protein, 5 aa, Artificial Sequence
  Synthetic polypeptide
SFYWS

SEQ ID NO: 787 - protein, 16 aa, Artificial Sequence
  Synthetic polypeptide
YIYYSGTTNYNPSLKS

SEQ ID NO: 788 - protein, 10 aa, Artificial Sequence
  Synthetic polypeptide
IAVAGFFFDY

SEQ ID NO: 789 - protein, 12 aa, Artificial Sequence
  Synthetic polypeptide
RASQSVNKNYLA

SEQ ID NO: 790 - protein, 7 aa, Artificial Sequence
  Synthetic polypeptide
GASSRAT

SEQ ID NO: 791 - protein, 9 aa, Artificial Sequence
  Synthetic polypeptide
QQYDRSPLT

SEQ ID NO: 792 - protein, 118 aa, Artificial Sequence
  Synthetic polypeptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSS

SEQ ID NO: 793 - protein, 108 aa, Artificial Sequence
  Synthetic polypeptide
EIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIK

SEQ ID NO: 794 - protein, 241 aa, Artificial Sequence
  Synthetic polypeptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIK

SEQ ID NO: 795 - protein, 496 aa, Artificial Sequence
  Synthetic polypeptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 796 - protein, 5 aa, Artificial Sequence
  Synthetic polypeptide
SFYWS

SEQ ID NO: 797 - protein, 16 aa, Artificial Sequence
  Synthetic polypeptide
YIYYSGTTNYNPSLKS

SEQ ID NO: 798 - protein, 10 aa, Artificial Sequence
  Synthetic polypeptide
IAVAGFFFDY

SEQ ID NO: 799 - protein, 12 aa, Artificial Sequence
  Synthetic polypeptide
RASQSVNKNYLA

SEQ ID NO: 800 - protein, 7 aa, Artificial Sequence
  Synthetic polypeptide
GASSRAT

SEQ ID NO: 801 - protein, 9 aa, Artificial Sequence
  Synthetic polypeptide
QQYDRSPLT

SEQ ID NO: 802 - protein, 118 aa, Artificial Sequence
  Synthetic polypeptide
QVQLQESGPGLVKPSQTLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSS

SEQ ID NO: 803 - protein, 108 aa, Artificial Sequence; identical to SEQ ID NO: 793
  Synthetic polypeptide

SEQ ID NO: 804 - protein, 241 aa, Artificial Sequence
  Synthetic polypeptide
QVQLQESGPGLVKPSQTLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIK

SEQ ID NO: 805 - protein, 496 aa, Artificial Sequence
  Synthetic polypeptide
QVQLQESGPGLVKPSQTLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 806 - protein, 5 aa, Artificial Sequence
  Synthetic polypeptide
SFYWS

SEQ ID NO: 807 - protein, 16 aa, Artificial Sequence
  Synthetic polypeptide
YIYYSGTTNYNPSLKS

SEQ ID NO: 808 - protein, 10 aa, Artificial Sequence
  Synthetic polypeptide
IAVAGFFFDY

SEQ ID NO: 809 - protein, 12 aa, Artificial Sequence
  Synthetic polypeptide
RASQSVNKNYLA

SEQ ID NO: 810 - protein, 7 aa, Artificial Sequence
  Synthetic polypeptide
GASSRAT

SEQ ID NO: 811 - protein, 9 aa, Artificial Sequence
  Synthetic polypeptide
QQYDRSPLT

SEQ ID NO: 812 - protein, 119 aa, Artificial Sequence
  Synthetic polypeptide
QVQLQEWGPGLVKPSETLSLTCTVSGASISSFYWSWIRQPPGKGLEWIGYIYYSGTTNYNPSLKSRVTISVDTSKNQLSLKLSSVTAADTAVYYCARIAVAGFFFDYWGQGTLVTVSSK

SEQ ID NO: 813 - protein, 108 aa, Artificial Sequence
  Synthetic polypeptide
EIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVDIK

SEQ ID NO: 814 - protein, 241 aa, Artificial Sequence
  Synthetic polypeptide
QVQLQEWGPGLVKPSETLSLTCTVSGASISSFYWSWIRQPPGKGLEWIGYIYYSGTTNYNPSLKSRVTISVDTSKNQLSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVDIK

SEQ ID NO: 815 - protein, 496 aa, Artificial Sequence
  Synthetic polypeptide
QVQLQEWGPGLVKPSETLSLTCTVSGASISSFYWSWIRQPPGKGLEWIGYIYYSGTTNYNPSLKSRVTISVDTSKNQLSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 816 - protein, 5 aa, Artificial Sequence
  Synthetic polypeptide
SFYWS

SEQ ID NO: 817 - protein, 16 aa, Artificial Sequence
  Synthetic polypeptide
YIYYSGTTNYNPSLKS

SEQ ID NO: 818 - protein, 10 aa, Artificial Sequence
  Synthetic polypeptide
IAVAGFFFDY

SEQ ID NO: 819 - protein, 12 aa, Artificial Sequence
  Synthetic polypeptide
RASQSVNKNYLA

SEQ ID NO: 820 - protein, 7 aa, Artificial Sequence
  Synthetic polypeptide
GASSRAT

SEQ ID NO: 821 - protein, 9 aa, Artificial Sequence
  Synthetic polypeptide
QQYDRSPLT

SEQ ID NO: 822 - protein, 118 aa, Artificial Sequence; identical to SEQ ID NO: 792
  Synthetic polypeptide

SEQ ID NO: 823 - protein, 108 aa, Artificial Sequence
  Synthetic polypeptide
EIVLTQSPGTLSLSPGESATLSCRASQSVNKNYLAWYQQKPGQAPRLLIYGASSRATGIPDRFSGSGSGTDFTLTISRLEPEDFAVYYCQQYDRSPLTFGGGTRLEIK

SEQ ID NO: 824 - protein, 241 aa, Artificial Sequence
  Synthetic polypeptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGESATLSCRASQSVNKNYLAWYQQKPGQAPRLLIYGASSRATGIPDRFSGSGSGTDFTLTISRLEPEDFAVYYCQQYDRSPLTFGGGTRLEIK

SEQ ID NO: 825 - protein, 496 aa, Artificial Sequence
  Synthetic polypeptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGESATLSCRASQSVNKNYLAWYQQKPGQAPRLLIYGASSRATGIPDRFSGSGSGTDFTLTISRLEPEDFAVYYCQQYDRSPLTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 826 - protein, 5 aa, Artificial Sequence
  Synthetic polypeptide
SYYWS

SEQ ID NO: 827 - protein, 16 aa, Artificial Sequence
  Synthetic polypeptide
YIFYNGITNYNPSLKS

SEQ ID NO: 828 - protein, 10 aa, Artificial Sequence
  Synthetic polypeptide
IHSGSFSFDY

SEQ ID NO: 829 - protein, 12 aa, Artificial Sequence
  Synthetic polypeptide
RASQSVSRGYLA

SEQ ID NO: 830 - protein, 7 aa, Artificial Sequence
  Synthetic polypeptide
GASSRAT

SEQ ID NO: 831 - protein, 9 aa, Artificial Sequence
  Synthetic polypeptide
QQYDTSPIT

SEQ ID NO: 832 - protein, 118 aa, Artificial Sequence
  Synthetic polypeptide
QVQLQESGPGLVKPSQTLSLTCTVSGGSISSYYWSWIRQPPGKGLEWIGYIFYNGITNYNPSLKSRVTISLDTSKNQFSLKLSSVTAADTAKYYCARIHSGSFSFDYWDQGTLVTVSS

SEQ ID NO: 833 - protein, 108 aa, Artificial Sequence
  Synthetic polypeptide
EIVMTQSPGTLSLSPGERATLSCRASQSVSRGYLAWYQQKPGQAPRLLIYGASSRATDIPDRFSGSGSGTDFTLTISRLEPEDFAVYYCQQYDTSPITFGQGTKVEIK

SEQ ID NO: 834 - protein, 241 aa, Artificial Sequence
  Synthetic polypeptide
QVQLQESGPGLVKPSQTLSLTCTVSGGSISSYYWSWIRQPPGKGLEWIGYIFYNGITNYNPSLKSRVTISLDTSKNQFSLKLSSVTAADTAKYYCARIHSGSFSFDYWDQGTLVTVSSGGGGSGGGGSGGGGSEIVMTQSPGTLSLSPGERATLSCRASQSVSRGYLAWYQQKPGQAPRLLIYGASSRATDIPDRFSGSGSGTDFTLTISRLEPEDFAVYYCQQYDTSPITFGQGTKVEIK

SEQ ID NO: 835 - protein, 496 aa, Artificial Sequence
  Synthetic polypeptide
QVQLQESGPGLVKPSQTLSLTCTVSGGSISSYYWSWIRQPPGKGLEWIGYIFYNGITNYNPSLKSRVTISLDTSKNQFSLKLSSVTAADTAKYYCARIHSGSFSFDYWDQGTLVTVSSGGGGSGGGGSGGGGSEIVMTQSPGTLSLSPGERATLSCRASQSVSRGYLAWYQQKPGQAPRLLIYGASSRATDIPDRFSGSGSGTDFTLTISRLEPEDFAVYYCQQYDTSPITFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 836 - protein, 5 aa, Artificial Sequence
  Synthetic polypeptide
SYYMH

SEQ ID NO: 837 - protein, 17 aa, Artificial Sequence
  Synthetic polypeptide
IINPSDGSTNYAQNFQG

SEQ ID NO: 838 - protein, 14 aa, Artificial Sequence
  Synthetic polypeptide
GGNSAFYSYYDMDV

SEQ ID NO: 839 - protein, 16 aa, Artificial Sequence
  Synthetic polypeptide
RSSQSLVYRDGNTYLS

SEQ ID NO: 840 - protein, 7 aa, Artificial Sequence
  Synthetic polypeptide
KVSNWQS

SEQ ID NO: 841 - protein, 9 aa, Artificial Sequence
  Synthetic polypeptide
MQGTHWPPT

SEQ ID NO: 842 - protein, 123 aa, Artificial Sequence
  Synthetic polypeptide
QVQLVQSGAEVKKPGASVKVSCKASGYTFTSYYMHWVRQAPGQGLEWMGIINPSDGSTNYAQNFQGRVTMTRDTSTNTVYMELSSLRSEDTAVYYCARGGNSAFYSYYDMDVWGQGTTVTVSS

SEQ ID NO: 843 - protein, 112 aa, Artificial Sequence
  Synthetic polypeptide
DVVMTQSPLSLPVTLGQPASISCRSSQSLVYRDGNTYLSWFQQRPGQSPRRLIYKVSNWQSGVPDRFSGSGSGTDFTLKISRVEAEDVGVYFCMQGTHWPPTFGQGTKVEIK

SEQ ID NO: 844 - protein, 250 aa, Artificial Sequence
  Synthetic polypeptide
QVQLVQSGAEVKKPGASVKVSCKASGYTFTSYYMHWVRQAPGQGLEWMGIINPSDGSTNYAQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLVYRDGNTYLSWFQQRPGQSPRRLIYKVSNWQSGVPDRFSGSGSGTDFTLKISRVEAEDVGVYFCMQGTHWPPTFGQGTKVEIK

SEQ ID NO: 845 - protein, 505 aa, Artificial Sequence
  Synthetic polypeptide
QVQLVQSGAEVKKPGASVKVSCKASGYTFTSYYMHWVRQAPGQGLEWMGIINPSDGSTNYAQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLVYRDGNTYLSWFQQRPGQSPRRLIYKVSNWQSGVPDRFSGSGSGTDFTLKISRVEAEDVGVYFCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 846 - protein, 5 aa, Artificial Sequence
  Synthetic polypeptide
NYYMH

SEQ ID NO: 847 - protein, 17 aa, Artificial Sequence
  Synthetic polypeptide
IINPSDGSTSYAQKFQG

SEQ ID NO: 848 - protein, 14 aa, Artificial Sequence
  Synthetic polypeptide
GGNSAFYSYYDMDV

SEQ ID NO: 849 - protein, 16 aa, Artificial Sequence
  Synthetic polypeptide
RSSQSLVYRDGNTYLS

SEQ ID NO: 850 - protein, 7 aa, Artificial Sequence
  Synthetic polypeptide
KVSNWQS

SEQ ID NO: 851 - protein, 9 aa, Artificial Sequence
  Synthetic polypeptide
MQGTHWPPT

SEQ ID NO: 852 - protein, 123 aa, Artificial Sequence
  Synthetic polypeptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSS

SEQ ID NO: 853 - protein, 112 aa, Artificial Sequence
  Synthetic polypeptide
DVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK

SEQ ID NO: 854 - protein, 250 aa, Artificial Sequence
  Synthetic polypeptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK

SEQ ID NO: 855 - protein, 505 aa, Artificial Sequence
  Synthetic polypeptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 856 - protein, 5 aa, Artificial Sequence
  Synthetic polypeptide
GYYIH

SEQ ID NO: 857 - protein, 17 aa, Artificial Sequence
  Synthetic polypeptide
IINPSDGSTSYGQNFQG

SEQ ID NO: 858 - protein, 14 aa, Artificial Sequence
  Synthetic polypeptide
GGNSAFYSYYDMDV

SEQ ID NO: 859 - protein, 16 aa, Artificial Sequence
  Synthetic polypeptide
RSSQSLAYRDGNTYLS

SEQ ID NO: 860 - protein, 7 aa, Artificial Sequence
  Synthetic polypeptide
KVSNWQS

SEQ ID NO: 861 - protein, 9 aa, Artificial Sequence
  Synthetic polypeptide
MQGTHWPPT

SEQ ID NO: 862 - protein, 123 aa, Artificial Sequence
  Synthetic polypeptide
QVQLVQSGAEVKKPGASVKVSCKASGYTFTGYYIHWVRQAPGQGLEWMGIINPSDGSTSYGQNFQGRVTMTRDTSTNTVYMELSSLRSEDTAVYYCARGGNSAFYSYYDMDVWGQGTTVTVSS

SEQ ID NO: 863 - protein, 112 aa, Artificial Sequence
  Synthetic polypeptide
DVVMTQSPLSLPVTLGQPASISCRSSQSLAYRDGNTYLSWFQQRPGQSPRRLIYKVSNWQSGVPDRFSGSGSGTDFTLKISRVEAEDVGVYFCMQGTHWPPTFGQGTKVEIK

SEQ ID NO: 864 - protein, 250 aa, Artificial Sequence
  Synthetic polypeptide
QVQLVQSGAEVKKPGASVKVSCKASGYTFTGYYIHWVRQAPGQGLEWMGIINPSDGSTSYGQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLAYRDGNTYLSWFQQRPGQSPRRLIYKVSNWQSGVPDRFSGSGSGTDFTLKISRVEAEDVGVYFCMQGTHWPPTFGQGTKVEIK

SEQ ID NO: 865 - protein, 505 aa, Artificial Sequence
  Synthetic polypeptide
QVQLVQSGAEVKKPGASVKVSCKASGYTFTGYYIHWVRQAPGQGLEWMGIINPSDGSTSYGQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLAYRDGNTYLSWFQQRPGQSPRRLIYKVSNWQSGVPDRFSGSGSGTDFTLKISRVEAEDVGVYFCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 866 - protein, 5 aa, Artificial Sequence
  Synthetic polypeptide
NYGMH

SEQ ID NO: 867 - protein, 17 aa, Artificial Sequence
  Synthetic polypeptide
VISHHGSSKYYARSVKG

SEQ ID NO: 868 - protein, 9 aa, Artificial Sequence
  Synthetic polypeptide
DWWELVFDY

SEQ ID NO: 869 - protein, 16 aa, Artificial Sequence
  Synthetic polypeptide
KSSQSLLHSDGKTFLY

SEQ ID NO: 870 - protein, 7 aa, Artificial Sequence
  Synthetic polypeptide
EVSNRFS

SEQ ID NO: 871 - protein, 9 aa, Artificial Sequence
  Synthetic polypeptide
LQGIHLPFT

SEQ ID NO: 872 - protein, 118 aa, Artificial Sequence
  Synthetic polypeptide
QVQLVESGGGAVQPGRSLRLSCAASGFTFSNYGMHWVRQAPGKGLEWVAVISHHGSSKYYARSVKGRFTISRDNSKNTLYLEMNSLRAEDTAVYYCARDWWELVFDYWGQGTLVTVSS

SEQ ID NO: 873 - protein, 112 aa, Artificial Sequence
  Synthetic polypeptide
DIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGIHLPFTFGPGTKVEIK

SEQ ID NO: 874 - protein, 245 aa, Artificial Sequence
  Synthetic polypeptide
QVQLVESGGGAVQPGRSLRLSCAASGFTFSNYGMHWVRQAPGKGLEWVAVISHHGSSKYYARSVKGRFTISRDNSKNTLYLEMNSLRAEDTAVYYCARDWWELVFDYWGQGTLVTVSSGGGGSGGGGSGGGGSDIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGIHLPFTFGPGTKVEIK

SEQ ID NO: 875 - protein, 500 aa, Artificial Sequence
  Synthetic polypeptide
QVQLVESGGGAVQPGRSLRLSCAASGFTFSNYGMHWVRQAPGKGLEWVAVISHHGSSKYYARSVKGRFTISRDNSKNTLYLEMNSLRAEDTAVYYCARDWWELVFDYWGQGTLVTVSSGGGGSGGGGSGGGGSDIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGIHLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 876 - protein, 7 aa, Artificial Sequence
  Synthetic polypeptide
NSRMGVS

SEQ ID NO: 877 - protein, 16 aa, Artificial Sequence
  Synthetic polypeptide
HIFSNDGKSYSTSLKS

SEQ ID NO: 878 - protein, 15 aa, Artificial Sequence
  Synthetic polypeptide
YNYDSSGYYYSFFDY

SEQ ID NO: 879 - protein, 11 aa, Artificial Sequence
  Synthetic polypeptide
RASQSISSYLN

SEQ ID NO: 880 - protein, 7 aa, Artificial Sequence
  Synthetic polypeptide
AASSLQS

SEQ ID NO: 881 - protein, 9 aa, Artificial Sequence
  Synthetic polypeptide
QQGYSSPFT

SEQ ID NO: 882 - protein, 125 aa, Artificial Sequence
  Synthetic polypeptide
QVTLKESGPMLVKPTETLTLTCTVSGFSLSNSRMGVSWIRQPPGRALEWLAHIFSNDGKSYSTSLKSRLTISKDTSKSQVVLTMTNMDPVDTATYYCARYNYDSSGYYYSFFDYWGQGTLVTVSS

SEQ ID NO: 883 - protein, 107 aa, Artificial Sequence
  Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQGYSSPFTFGGGTKVEIK

SEQ ID NO: 884 - protein, 247 aa, Artificial Sequence
  Synthetic polypeptide
QVTLKESGPMLVKPTETLTLTCTVSGFSLSNSRMGVSWIRQPPGRALEWLAHIFSNDGKSYSTSLKSRLTISKDTSKSQVVLTMTNMDPVDTATYYCARYNYDSSGYYYSFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQGYSSPFTFGGGTKVEIK

SEQ ID NO: 885 - protein, 502 aa, Artificial Sequence
  Synthetic polypeptide
QVTLKESGPMLVKPTETLTLTCTVSGFSLSNSRMGVSWIRQPPGRALEWLAHIFSNDGKSYSTSLKSRLTISKDTSKSQVVLTMTNMDPVDTATYYCARYNYDSSGYYYSFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQGYSSPFTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 886 - protein, 7 aa, Artificial Sequence
  Synthetic polypeptide
NARMGVS

SEQ ID NO: 887 - protein, 16 aa, Artificial Sequence
  Synthetic polypeptide
HIFSTDEKSYSTSLKS

SEQ ID NO: 888 - protein, 15 aa, Artificial Sequence
  Synthetic polypeptide
YYYDSSGYYYSFFDY

SEQ ID NO: 889 - protein, 11 aa, Artificial Sequence
  Synthetic polypeptide
RASQSIRSYLN

SEQ ID NO: 890 - protein, 7 aa, Artificial Sequence
  Synthetic polypeptide
GASNLQS

SEQ ID NO: 891 - protein, 9 aa, Artificial Sequence
  Synthetic polypeptide
QQSYSSPFT

SEQ ID NO: 892 - protein, 125 aa, Artificial Sequence
  Synthetic polypeptide
QVTLKESGPVLVKPTETLTLTCTVSGFSLSNARMGVSWLRQPPGKALEWLAHIFSTDEKSYSTSLKSRLTISKDTSKSQVVLTMTNMDPVDTATYYCARYYYDSSGYYYSFFDYWGQGTLVTVSS

SEQ ID NO: 893 - protein, 107 aa, Artificial Sequence
  Synthetic polypeptide
DIQMTQSPSSLSASVGDRVTITCRASQSIRSYLNWYQQKPGKAPKLLIYGASNLQSGVPSRFSGSGSGTDFTLTISSLQPEDFATYYCQQSYSSPFTFGGGTKVEIK

SEQ ID NO: 894 - protein, 247 aa, Artificial Sequence
  Synthetic polypeptide
QVTLKESGPVLVKPTETLTLTCTVSGFSLSNARMGVSWLRQPPGKALEWLAHIFSTDEKSYSTSLKSRLTISKDTSKSQVVLTMTNMDPVDTATYYCARYYYDSSGYYYSFFDYWGQGTLVTVSSGGGGSGGGGSGGGGSDIQMTQSPSSLSASVGDRVTITCRASQSIRSYLNWYQQKPGKAPKLLIYGASNLQSGVPSRFSGSGSGTDFTLTISSLQPEDFATYYCQQSYSSPFTFGGGTKVEIK

SEQ ID NO: 895 - protein, 502 aa, Artificial Sequence
  Synthetic polypeptide
QVTLKESGPVLVKPTETLTLTCTVSGFSLSNARMGVSWLRQPPGKALEWLAHIFSTDEKSYSTSLKSRLTISKDTSKSQVVLTMTNMDPVDTATYYCARYYYDSSGYYYSFFDYWGQGTLVTVSSGGGGSGGGGSGGGGSDIQMTQSPSSLSASVGDRVTITCRASQSIRSYLNWYQQKPGKAPKLLIYGASNLQSGVPSRFSGSGSGTDFTLTISSLQPEDFATYYCQQSYSSPFTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 896 - protein, 5 aa, Artificial Sequence
  Synthetic polypeptide
SYYIH

SEQ ID NO: 897 - protein, 17 aa, Artificial Sequence
  Synthetic polypeptide
IINPSGGSKSYAQKFRG

SEQ ID NO: 898 - protein, 12 aa, Artificial Sequence
  Synthetic polypeptide
SMSTVTSDAFDI

SEQ ID NO: 899 - protein, 11 aa, Artificial Sequence
  Synthetic polypeptide
RASQSISNYLN

SEQ ID NO: 900 - protein, 7 aa, Artificial Sequence
  Synthetic polypeptide
AASSLQS

SEQ ID NO: 901 - protein, 9 aa, Artificial Sequence
  Synthetic polypeptide
QQSYSAPLT

SEQ ID NO: 902 - protein, 121 aa, Artificial Sequence
  Synthetic polypeptide
QVQLVQSGAEVKKPGASVKVSCKASGYAFTSYYIHWVRQAPGQGLEWMGIINPSGGSKSYAQKFRGRVTMTRDTSTSTVYMELSSLTSEDTAVYYCARSMSTVTSDAFDIWGQGTMVTVSS

SEQ ID NO: 903 - protein, 107 aa, Artificial Sequence
  Synthetic polypeptide
DIQMTQSPSSLSASVGDRVTITCRASQSISNYLNWYQQKPGKAPKLLIYAASSLQSGVPSRFSGSGSGTEFTLTISSLQPEDFATYYCQQSYSAPLTFGGGTKVDIK

SEQ ID NO: 904 - protein, 243 aa, Artificial Sequence
  Synthetic polypeptide
QVQLVQSGAEVKKPGASVKVSCKASGYAFTSYYIHWVRQAPGQGLEWMGIINPSGGSKSYAQKFRGRVTMTRDTSTSTVYMELSSLTSEDTAVYYCARSMSTVTSDAFDIWGQGTMVTVSSGGGGSGGGGSGGGGSDIQMTQSPSSLSASVGDRVTITCRASQSISNYLNWYQQKPGKAPKLLIYAASSLQSGVPSRFSGSGSGTEFTLTISSLQPEDFATYYCQQSYSAPLTFGGGTKVDIK

SEQ ID NO: 905 - protein, 498 aa, Artificial Sequence
  Synthetic polypeptide
QVQLVQSGAEVKKPGASVKVSCKASGYAFTSYYIHWVRQAPGQGLEWMGIINPSGGSKSYAQKFRGRVTMTRDTSTSTVYMELSSLTSEDTAVYYCARSMSTVTSDAFDIWGQGTMVTVSSGGGGSGGGGSGGGGSDIQMTQSPSSLSASVGDRVTITCRASQSISNYLNWYQQKPGKAPKLLIYAASSLQSGVPSRFSGSGSGTEFTLTISSLQPEDFATYYCQQSYSAPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 906 - protein, 5 aa, Artificial Sequence
  Synthetic polypeptide
DYGIH

SEQ ID NO: 907 - protein, 17 aa, Artificial Sequence
  Synthetic polypeptide
VISYHGSNKYYARSVKG

SEQ ID NO: 908 - protein, 8 aa, Artificial Sequence
  Synthetic polypeptide
EIPFGMDV

SEQ ID NO: 909 - protein, 16 aa, Artificial Sequence
  Synthetic polypeptide
RSSQSLLHSDGYNYLD

SEQ ID NO: 910 - protein, 7 aa, Artificial Sequence
  Synthetic polypeptide
LGSNRAS

SEQ ID NO: 911 - protein, 9 aa, Artificial Sequence
  Synthetic polypeptide
MQALQTPLT

SEQ ID NO: 912 - protein, 117 aa, Artificial Sequence
  Synthetic polypeptide
QVQLVESGGGVVQSGRSLRLSCAASGFTFSDYGIHWVRQAPGKGLEWVAVISYHGSNKYYARSVKGRFTVSRDNSKNTLYLQMNSLRAEDTAVYYCAREIPFGMDVWGQGTTVTVSS

SEQ ID NO: 913 - protein, 112 aa, Artificial Sequence
  Synthetic polypeptide
DIVMTQTPLSLPVTPGEPASISCRSSQSLLHSDGYNYLDWYLQKPGQSPQLLIYLGSNRASGVPDRFSGSGSGTDFTLTISRVEAEDVGVYYCMQALQTPLTFGGGTKVDIK

SEQ ID NO: 914 - protein, 244 aa, Artificial Sequence
  Synthetic polypeptide
QVQLVESGGGVVQSGRSLRLSCAASGFTFSDYGIHWVRQAPGKGLEWVAVISYHGSNKYYARSVKGRFTVSRDNSKNTLYLQMNSLRAEDTAVYYCAREIPFGMDVWGQGTTVTVSSGGGGSGGGGSGGGGSDIVMTQTPLSLPVTPGEPASISCRSSQSLLHSDGYNYLDWYLQKPGQSPQLLIYLGSNRASGVPDRFSGSGSGTDFTLTISRVEAEDVGVYYCMQALQTPLTFGGGTKVDIK

SEQ ID NO: 915 - protein, 499 aa, Artificial Sequence
  Synthetic polypeptide
QVQLVESGGGVVQSGRSLRLSCAASGFTFSDYGIHWVRQAPGKGLEWVAVISYHGSNKYYARSVKGRFTVSRDNSKNTLYLQMNSLRAEDTAVYYCAREIPFGMDVWGQGTTVTVSSGGGGSGGGGSGGGGSDIVMTQTPLSLPVTPGEPASISCRSSQSLLHSDGYNYLDWYLQKPGQSPQLLIYLGSNRASGVPDRFSGSGSGTDFTLTISRVEAEDVGVYYCMQALQTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 916 - protein, 5 aa, Artificial Sequence
  Synthetic polypeptide
GYYMH

SEQ ID NO: 917 - protein, 17 aa, Artificial Sequence
  Synthetic polypeptide
WINPNSGDTNYAQKFQG

SEQ ID NO: 918 - protein, 12 aa, Artificial Sequence
  Synthetic polypeptide
DANIAALDAFEI

SEQ ID NO: 919 - protein, 11 aa, Artificial Sequence
  Synthetic polypeptide
RASQSISSYLN

SEQ ID NO: 920 - protein, 7 aa, Artificial Sequence
  Synthetic polypeptide
AASSLQS

SEQ ID NO: 921 - protein, 9 aa, Artificial Sequence
  Synthetic polypeptide
QQSYSTPLT

SEQ ID NO: 922 - protein, 121 aa, Artificial Sequence
  Synthetic polypeptide
QVQLVQSGAEVKKPGASVKVSCKASGYTFTGYYMHWVRQAPGQGLEWMGWINPNSGDTNYAQKFQGRVTMTRDTSISTAYMELSRLTSDDTAVYYCARDANIAALDAFEIWGQGTMVTVSS

SEQ ID NO: 923 - protein, 107 aa, Artificial Sequence [sequence omitted]

SEQ ID NO: 924 - protein, 243 aa, Artificial Sequence
  Synthetic polypeptide
QVQLVQSGAEVKKPGASVKVSCKASGYTFTGYYMHWVRQAPGQGLEWMGWINPNSGDTNYAQKFQGRVTMTRDTSISTAYMELSRLTSDDTAVYYCARDANIAALDAFEIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 925 - protein, 498 aa, Artificial Sequence
  Synthetic polypeptide
QVQLVQSGAEVKKPGASVKVSCKASGYTFTGYYMHWVRQAPGQGLEWMGWINPNSGDTNYAQKFQGRVTMTRDTSISTAYMELSRLTSDDTAVYYCARDANIAALDAFEIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 926 - protein, 7 aa, Artificial Sequence
  Synthetic polypeptide
NARMGVS

SEQ ID NO: 927 - protein, 16 aa, Artificial Sequence
  Synthetic polypeptide
HIFSNAEKSYRTSLKS

SEQ ID NO: 928 - protein, 17 aa, Artificial Sequence
  Synthetic polypeptide
IPGYGGNGDYHYYGMDV

SEQ ID NO: 929 - protein, 11 aa, Artificial Sequence
  Synthetic polypeptide
RASQGIRNDLG

SEQ ID NO: 930 - protein, 7 aa, Artificial Sequence
  Synthetic polypeptide
ASSTLQS

SEQ ID NO: 931 - protein, 9 aa, Artificial Sequence
  Synthetic polypeptide
LQHNNFPWT

SEQ ID NO: 932 - protein, 127 aa, Artificial Sequence
  Synthetic polypeptide
QVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSS

SEQ ID NO: 933 - protein, 107 aa, Artificial Sequence
  Synthetic polypeptide
DIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIK

SEQ ID NO: 934 - protein, 249 aa, Artificial Sequence
  Synthetic polypeptide
QVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIK

SEQ ID NO: 935 - protein, 504 aa, Artificial Sequence
  Synthetic polypeptide
QVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 936 - protein, 7 aa, Artificial Sequence
  Synthetic polypeptide
NARMGVS

SEQ ID NO: 937 - protein, 16 aa, Artificial Sequence
  Synthetic polypeptide
HIFSNDEKTYSTSLKS

SEQ ID NO: 938 - protein, 15 aa, Artificial Sequence
  Synthetic polypeptide
IPYYGSGSHNYGMDV

SEQ ID NO: 939 - protein, 11 aa, Artificial Sequence
  Synthetic polypeptide
RASQDIRNDFG

SEQ ID NO: 940 - protein, 7 aa, Artificial Sequence
  Synthetic polypeptide
AASTLQS

SEQ ID NO: 941 - protein, 9 aa, Artificial Sequence
  Synthetic polypeptide
LQYNTYPWT

SEQ ID NO: 942 - protein, 125 aa, Artificial Sequence
  Synthetic polypeptide
QVTLKESGPVLVKPTETLTLTCTVSGFSLRNARMGVSWIRQPPGKALEWLAHIFSNDEKTYSTSLKSRLTISRDTSKGQVVLTMTKMDPVDTATYYCARIPYYGSGSHNYGMDVWGQGTTVTVSS

SEQ ID NO: 943 - protein, 107 aa, Artificial Sequence
  Synthetic polypeptide
DIQMTQSPSSLSASVGDRVTITCRASQDIRNDFGWYQQKPGKAPQRLLYAASTLQSGVPSRFSGSGSGTEFTLTISSLQPEDFATYYCLQYNTYPWTFGQGTKVEIK

SEQ ID NO: 944 - protein, 247 aa, Artificial Sequence
  Synthetic polypeptide
QVTLKESGPVLVKPTETLTLTCTVSGFSLRNARMGVSWIRQPPGKALEWLAHIFSNDEKTYSTSLKSRLTISRDTSKGQVVLTMTKMDPVDTATYYCARIPYYGSGSHNYGMDVWGQGTTVTVSSGGGGSGGGGSGGGGSDIQMTQSPSSLSASVGDRVTITCRASQDIRNDFGWYQQKPGKAPQRLLYAASTLQSGVPSRFSGSGSGTEFTLTISSLQPEDFATYYCLQYNTYPWTFGQGTKVEIK

SEQ ID NO: 945 - protein, 502 aa, Artificial Sequence
  Synthetic polypeptide
QVTLKESGPVLVKPTETLTLTCTVSGFSLRNARMGVSWIRQPPGKALEWLAHIFSNDEKTYSTSLKSRLTISRDTSKGQVVLTMTKMDPVDTATYYCARIPYYGSGSHNYGMDVWGQGTTVTVSSGGGGSGGGGSGGGGSDIQMTQSPSSLSASVGDRVTITCRASQDIRNDFGWYQQKPGKAPQRLLYAASTLQSGVPSRFSGSGSGTEFTLTISSLQPEDFATYYCLQYNTYPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 946 - protein, 7 aa, Artificial Sequence
  Synthetic polypeptide
NARMAVS

SEQ ID NO: 947 - protein, 16 aa, Artificial Sequence
  Synthetic polypeptide
HIFSNGEKSYSTSLKS

SEQ ID NO: 948 - protein, 13 aa, Artificial Sequence
  Synthetic polypeptide
IVGYSDWLLPFDH

SEQ ID NO: 949 - protein, 11 aa, Artificial Sequence
  Synthetic polypeptide
RASQNINRFLN

SEQ ID NO: 950 - protein, 7 aa, Artificial Sequence
  Synthetic polypeptide
AASSLQS

SEQ ID NO: 951 - protein, 9 aa, Artificial Sequence
  Synthetic polypeptide
LQHNSYPWT

SEQ ID NO: 952 - protein, 123 aa, Artificial Sequence
  Synthetic polypeptide
QVTLKESGPALVKPTETLTLTCTVSGFSLSNARMAVSWIRQPPGKALEWLAHIFSNGEKSYSTSLKSRLTISKDTSKTQVVLTMTNTDPVDTATYFCARIVGYSDWLLPFDHWGQGIMVTVSS

SEQ ID NO: 953 - protein, 107 aa, Artificial Sequence
  Synthetic polypeptide
DIQMTQSPSSLSASVGDRVTITCRASQNINRFLNWYQQKPGKAPKLLIYAASSLQSGVPSRFSGSGSGTDFTLTISSLQPEDFATYYCLQHNSYPWTFGQGTKVDIK

SEQ ID NO: 954 - protein, 245 aa, Artificial Sequence
  Synthetic polypeptide
QVTLKESGPALVKPTETLTLTCTVSGFSLSNARMAVSWIRQPPGKALEWLAHIFSNGEKSYSTSLKSRLTISKDTSKTQVVLTMTNTDPVDTATYFCARIVGYSDWLLPFDHWGQGIMVTVSSGGGGSGGGGSGGGGSDIQMTQSPSSLSASVGDRVTITCRASQNINRFLNWYQQKPGKAPKLLIYAASSLQSGVPSRFSGSGSGTDFTLTISSLQPEDFATYYCLQHNSYPWTFGQGTKVDIK

SEQ ID NO: 955 - protein, 500 aa, Artificial Sequence
  Synthetic polypeptide
QVTLKESGPALVKPTETLTLTCTVSGFSLSNARMAVSWIRQPPGKALEWLAHIFSNGEKSYSTSLKSRLTISKDTSKTQVVLTMTNTDPVDTATYFCARIVGYSDWLLPFDHWGQGIMVTVSSGGGGSGGGGSGGGGSDIQMTQSPSSLSASVGDRVTITCRASQNINRFLNWYQQKPGKAPKLLIYAASSLQSGVPSRFSGSGSGTDFTLTISSLQPEDFATYYCLQHNSYPWTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 956 - protein, 7 aa, Artificial Sequence
  Synthetic polypeptide
NAKMGVS

SEQ ID NO: 957 - protein, 16 aa, Artificial Sequence
  Synthetic polypeptide
HIFSNDEKSYSTSLKS

SEQ ID NO: 958 - protein, 14 aa, Artificial Sequence
  Synthetic polypeptide
IVGYGSGWYGYFDY

SEQ ID NO: 959 - protein, 11 aa, Artificial Sequence
  Synthetic polypeptide
RASQDIRDDLG

SEQ ID NO: 960 - protein, 7 aa, Artificial Sequence
  Synthetic polypeptide
GASTLQS

SEQ ID NO: 961 - protein, 9 aa, Artificial Sequence
  Synthetic polypeptide
LQHNSYPLT

SEQ ID NO: 962 - protein, 124 aa, Artificial Sequence
  Synthetic polypeptide
QVTLKESGPALVKPTETLTLTCTLSGFSLNNAKMGVSWIRQPPGKALEWLAHIFSNDEKSYSTSLKSRLTISKDTSKGQVVLTMTNMDPVDTATYYCARIVGYGSGWYGYFDYWGQGTLVTVSS

SEQ ID NO: 963 - protein, 107 aa, Artificial Sequence
  Synthetic polypeptide
DIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIK

SEQ ID NO: 964 - protein, 246 aa, Artificial Sequence
  Synthetic polypeptide
QVTLKESGPALVKPTETLTLTCTLSGFSLNNAKMGVSWIRQPPGKALEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIK

SEQ ID NO: 965 - protein, 501 aa, Artificial Sequence
  Synthetic polypeptide
QVTLKESGPALVKPTETLTLTCTLSGFSLNNAKMGVSWIRQPPGKALEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 966 - protein, 7 aa, Artificial Sequence
  Synthetic polypeptide
NARMGVS

SEQ ID NO: 967 - protein, 16 aa, Artificial Sequence
  Synthetic polypeptide
HIFWNDEKSYSTSLKS

SEQ ID NO: 968 - protein, 15 aa, Artificial Sequence
  Synthetic polypeptide
IPYYGSGSYNYGMDV

SEQ ID NO: 969 - protein, 11 aa, Artificial Sequence
  Synthetic polypeptide
RASQGIRNDLG

SEQ ID NO: 970 - protein, 7 aa, Artificial Sequence
  Synthetic polypeptide
AASSLQS

SEQ ID NO: 971 - protein, 9 aa, Artificial Sequence
  Synthetic polypeptide
LQHNTYPLT

SEQ ID NO: 972 - protein, 125 aa, Artificial Sequence
  Synthetic polypeptide
QVTLKESGPMLVKPTETLTLTCTFSGFSLRNARMGVSWIRQPPGKALEWLAHIFWNDEKSYSTSLKSRLTISKDTSKSQVVLTMTNMDPVDTATYYCARIPYYGSGSYNYGMDVWGQGTTVTVSS

SEQ ID NO: 973 - protein, 107 aa, Artificial Sequence
  Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNTYPLTFGGGTKVDIK

SEQ ID NO: 974 - protein, 247 aa, Artificial Sequence
  Synthetic polypeptide
QVTLKESGPMLVKPTETLTLTCTFSGFSLRNARMGVSWIRQPPGKALEWLAHIFWNDEKSYSTSLKSRLTISKDTSKSQVVLTMTNMDPVDTATYYCARIPYYGSGSYNYGMDVWGQGTTVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNTYPLTFGGGTKVDIK

SEQ ID NO: 975 - protein, 502 aa, Artificial Sequence
  Synthetic polypeptide
QVTLKESGPMLVKPTETLTLTCTFSGFSLRNARMGVSWIRQPPGKALEWLAHIFWNDEKSYSTSLKSRLTISKDTSKSQVVLTMTNMDPVDTATYYCARIPYYGSGSYNYGMDVWGQGTTVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNTYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 976 - protein, 7 aa, Artificial Sequence
  Synthetic polypeptide
NARMAVS

SEQ ID NO: 977 - protein, 16 aa, Artificial Sequence
  Synthetic polypeptide
HIFSNDEKSYSPSLKS

SEQ ID NO: 978 - protein, 14 aa, Artificial Sequence
  Synthetic polypeptide
IVGYGTGWYGFFDY

SEQ ID NO: 979 - protein, 11 aa, Artificial Sequence
  Synthetic polypeptide
RASQGIRNDLG

SEQ ID NO: 980 - protein, 7 aa, Artificial Sequence
  Synthetic polypeptide
AASVLQS

SEQ ID NO: 981 - protein, 9 aa, Artificial Sequence
  Synthetic polypeptide
LQHNSYPLT

SEQ ID NO: 982 - protein, 124 aa, Artificial Sequence
  Synthetic polypeptide
QVTLKESGPTLVKPTETLTLTCTLSGFSLNNARMAVSWIRQPPGKTLEWLAHIFSNDEKSYSPSLKSRLTISKDTSKSQVVLTMTNMDPEDTATYYCARIVGYGTGWYGFFDYWGQGILVTVSS

SEQ ID NO: 983 - protein, 107 aa, Artificial Sequence
  Synthetic polypeptide
DIQMTQSPSSLSASVGDRVTITCRASQGIRNDLGWFQQKPGKAPKRLIYAASVLQSGVPSRFSGSGSGTEFTLTISSLQPEDFATYYCLQHNSYPLTFGGGTKVDIK

SEQ ID NO: 984 - protein, 246 aa, Artificial Sequence
  Synthetic polypeptide
QVTLKESGPTLVKPTETLTLTCTLSGFSLNNARMAVSWIRQPPGKTLEWLAHIFSNDEKSYSPSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLGWFQQKPGKAPKRLIYAASVLQSGVPSRFSGSGSGTEFTLTISSLQPEDFATYYCLQHNSYPLTFGGGTKVDIK

SEQ ID NO: 985 - protein, 501 aa, Artificial Sequence
  Synthetic polypeptide
QVTLKESGPTLVKPTETLTLTCTLSGFSLNNARMAVSWIRQPPGKTLEWLAHIFSNDEKSYSPSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLGWFQQKPGKAPKRLIYAASVLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 986 - protein, 7 aa, Artificial Sequence
  Synthetic polypeptide
NARMGVS

SEQ ID NO: 987 - protein, 16 aa, Artificial Sequence
  Synthetic polypeptide
HIFSNDEKSYSTSLKN

SEQ ID NO: 988 - protein, 14 aa, Artificial Sequence
  Synthetic polypeptide
IVGYGTGWFGYFDY

SEQ ID NO: 989 - protein, 11 aa, Artificial Sequence
  Synthetic polypeptide
RASQDIRTDLA

SEQ ID NO: 990 - protein, 7 aa, Artificial Sequence
  Synthetic polypeptide
AASSLQS

SEQ ID NO: 991 - protein, 9 aa, Artificial Sequence
  Synthetic polypeptide
LQHNRYPLT

SEQ ID NO: 992 - protein, 124 aa, Artificial Sequence
  Synthetic polypeptide
QVTLKESGPTLVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWFGYFDYWGQGTQVTVSS

SEQ ID NO: 993 - protein, 107 aa, Artificial Sequence
  Synthetic polypeptide
DIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGGGTKVDIK

SEQ ID NO: 994 - protein, 246 aa, Artificial Sequence
  Synthetic polypeptide
QVTLKESGPTLVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGGGTKVDIK

SEQ ID NO: 995 - protein, 501 aa, Artificial Sequence
  Synthetic polypeptide
QVTLKESGPTLVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 996 - protein, 7 aa, Artificial Sequence
  Synthetic polypeptide
YARMGVS

SEQ ID NO: 997 - protein, 16 aa, Artificial Sequence
  Synthetic polypeptide
QIFSNDEKSYSTSLKS

SEQ ID NO: 998 - protein, 14 aa, Artificial Sequence
  Synthetic polypeptide
IVGYGTGWYGFFDY

SEQ ID NO: 999 - protein, 11 aa, Artificial Sequence
  Synthetic polypeptide
RASQGIRNDLG

SEQ ID NO: 1000 - protein, 7 aa, Artificial Sequence
  Synthetic polypeptide
AASSLQS

SEQ ID NO: 1001 - protein, 9 aa, Artificial Sequence
  Synthetic polypeptide
LQHNSYPLT

SEQ ID NO: 1002 - protein, 124 aa, Artificial Sequence
  Synthetic polypeptide
QVTLKESGPALVKPTETLTLTCTVSGFSLSYARMGVSWIRQPPGKALEWLAQIFSNDEKSYSTSLKSRLTISKGTSNSQVVLTMTNMDPEDTATYYCARIVGYGTGWYGFFDYWGQGILVTVSS

SEQ ID NO: 1003 - protein, 107 aa, Artificial Sequence
  Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVDIK

SEQ ID NO: 1004 - protein, 246 aa, Artificial Sequence
  Synthetic polypeptide
QVTLKESGPALVKPTETLTLTCTVSGFSLSYARMGVSWIRQPPGKALEWLAQIFSNDEKSYSTSLKSRLTISKGTSNSQVVLTMTNMDPEDTATYYCARIVGYGTGWYGFFDYWGQGILVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVDIK

SEQ ID NO: 1005 - protein, 501 aa, Artificial Sequence
  Synthetic polypeptide
QVTLKESGPALVKPTETLTLTCTVSGFSLSYARMGVSWIRQPPGKALEWLAQIFSNDEKSYSTSLKSRLTISKGTSNSQVVLTMTNMDPEDTATYYCARIVGYGTGWYGFFDYWGQGILVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1006 - protein, 7 aa, Artificial Sequence
  Synthetic polypeptide
NARMGVS

SEQ ID NO: 1007 - protein, 16 aa, Artificial Sequence
  Synthetic polypeptide
HIFSNDEKSYSTSLKS

SEQ ID NO: 1008 - protein, 17 aa, Artificial Sequence
  Synthetic polypeptide
IPGYGGNFYYHYYGMDV

SEQ ID NO: 1009 - protein, 11 aa, Artificial Sequence
  Synthetic polypeptide
RASQGIRNDLA

SEQ ID NO: 1010 - protein, 7 aa, Artificial Sequence
  Synthetic polypeptide
AASTVQS

SEQ ID NO: 1011 - protein, 9 aa, Artificial Sequence
  Synthetic polypeptide
LQHNSFPWT

SEQ ID NO: 1012 - protein, 127 aa, Artificial Sequence
  Synthetic polypeptide
QVTLKESGPTLVKPTETLTLTCTVSGFSLSNARMGVSWIRQPPGKALEWLAHIFSNDEKSYSTSLKSRLTISKDTSKSQVVLTMTNMDPVDTATYYCARIPGYGGNFYYHYYGMDVWGQGTTVTVSS

SEQ ID NO: 1013 - protein, 107 aa, Artificial Sequence
  Synthetic polypeptide
DIQMTQSPSSLSASVGDRVTITCRASQGIRNDLAWYQQKPGKAPKRLIYAASTVQSGVPSRFSGSGSGTEFALTISSLQPEDFATYYCLQHNSFPWTFGQGTKVDIK

SEQ ID NO: 1014 - protein, 249 aa, Artificial Sequence
  Synthetic polypeptide
QVTLKESGPTLVKPTETLTLTCTVSGFSLSNARMGVSWIRQPPGKALEWLAHIFSNDEKSYSTSLKSRLTISKDTSKSQVVLTMTNMDPVDTATYYCARIPGYGGNFYYHYYGMDVWGQGTTVTVSSGGGGSGGGGSGGGGSDIQMTQSPSSLSASVGDRVTITCRASQGIRNDLAWYQQKPGKAPKRLIYAASTVQSGVPSRFSGSGSGTEFALTISSLQPEDFATYYCLQHNSFPWTFGQGTKVDIK

SEQ ID NO: 1015 - protein, 504 aa, Artificial Sequence [sequence omitted]

SEQ ID NO: 1016 - protein, 7 aa, Artificial Sequence
  Synthetic polypeptide
NARMGVS

SEQ ID NO: 1017 - protein, 16 aa, Artificial Sequence
  Synthetic polypeptide
HIFSNDEKSYSTSLKS

SEQ ID NO: 1018 - protein, 14 aa, Artificial Sequence
  Synthetic polypeptide
MPEYSSGWSGAFDI

SEQ ID NO: 1019 - protein, 11 aa, Artificial Sequence
  Synthetic polypeptide
RASQDIRDDLG

SEQ ID NO: 1020 - protein, 7 aa, Artificial Sequence
  Synthetic polypeptide
GASTLQS

SEQ ID NO: 1021 - protein, 9 aa, Artificial Sequence
  Synthetic polypeptide
LQHNSYPLT

SEQ ID NO: 1022 - protein, 124 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSS

SEQ ID NO: 1023 - protein, 107 aa, Artificial Sequence; identical to SEQ ID NO: 963
  Synthetic polypeptide

SEQ ID NO: 1024 - protein, 246 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIK

SEQ ID NO: 1025 - protein, 501 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1026 - protein, 7 aa, Artificial Sequence
  Synthetic polypeptide
NAKMGVS

SEQ ID NO: 1027 - protein, 16 aa, Artificial Sequence
  Synthetic polypeptide
QIFSNGEKSYSTSLKS

SEQ ID NO: 1028 - protein, 14 aa, Artificial Sequence
  Synthetic polypeptide
IVGYGSGWYGYFDY

SEQ ID NO: 1029 - protein, 11 aa, Artificial Sequence
  Synthetic polypeptide
RASQGIRNDLG

SEQ ID NO: 1030 - protein, 7 aa, Artificial Sequence
  Synthetic polypeptide
GASTLQS

SEQ ID NO: 1031 - protein, 9 aa, Artificial Sequence
  Synthetic polypeptide
LQHNSYPLT

SEQ ID NO: 1032 - protein, 124 aa, Artificial Sequence
  Synthetic polypeptide
QVTLKESGPVLVKPTETLTLTCTLSGFSLNNAKMGVSWIRQPPGKALEWLAQIFSNGEKSYSTSLKSRLTISKDTSKGQVVLTMTNMDPVDTATYYCSRIVGYGSGWYGYFDYWGQGTLVTVSS

SEQ ID NO: 1033 - protein, 107 aa, Artificial Sequence
  Synthetic polypeptide
DIQMTQSPSSLSASVGDRVTITCRASQGIRNDLGWYQQKPGKAPKRLIYGASTLQSGVPSRFSGSGSGTEFTLTISSLQPEDFATYYCLQHNSYPLTFGGGTKVEIK

SEQ ID NO: 1034 - protein, 246 aa, Artificial Sequence
  Synthetic polypeptide
QVTLKESGPVLVKPTETLTLTCTLSGFSLNNAKMGVSWIRQPPGKALEWLAQIFSNGEKSYSTSLKSRLTISKDTSKGQVVLTMTNMDPVDTATYYCSRIVGYGSGWYGYFDYWGQGTLVTVSSGGGGSGGGGSGGGGSDIQMTQSPSSLSASVGDRVTITCRASQGIRNDLGWYQQKPGKAPKRLIYGASTLQSGVPSRFSGSGSGTEFTLTISSLQPEDFATYYCLQHNSYPLTFGGGTKVEIK

SEQ ID NO: 1035 - protein, 501 aa, Artificial Sequence
  Synthetic polypeptide
QVTLKESGPVLVKPTETLTLTCTLSGFSLNNAKMGVSWIRQPPGKALEWLAQIFSNGEKSYSTSLKSRLTISKDTSKGQVVLTMTNMDPVDTATYYCSRIVGYGSGWYGYFDYWGQGTLVTVSSGGGGSGGGGSGGGGSDIQMTQSPSSLSASVGDRVTITCRASQGIRNDLGWYQQKPGKAPKRLIYGASTLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1036 - protein, 7 aa, Artificial Sequence
  Synthetic polypeptide
NARMGVS

SEQ ID NO: 1037 - protein, 16 aa, Artificial Sequence
  Synthetic polypeptide
NIFSNDEKSYSTSLKS

SEQ ID NO: 1038 - protein, 14 aa, Artificial Sequence
  Synthetic polypeptide
IVGYGSGWYGYFDY

SEQ ID NO: 1039 - protein, 11 aa, Artificial Sequence
  Synthetic polypeptide
RASQGIRNDLG

SEQ ID NO: 1040 - protein, 7 aa, Artificial Sequence
  Synthetic polypeptide
AASSLQS

SEQ ID NO: 1041 - protein, 9 aa, Artificial Sequence
  Synthetic polypeptide
LQHNSYPLT

SEQ ID NO: 1042 - protein, 124 aa, Artificial Sequence
  Synthetic polypeptide
QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSS

SEQ ID NO: 1043 - protein, 107 aa, Artificial Sequence
  Synthetic polypeptide
DIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIK

SEQ ID NO: 1044 - protein, 246 aa, Artificial Sequence
  Synthetic polypeptide
QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIK

SEQ ID NO: 1045 - protein, 501 aa, Artificial Sequence
  Synthetic polypeptide
QVTLKESGPALVKPTETLTLTCTVSGFSLSNARMGVSWIRQPPGKALEWLANIFSNDEKSYSTSLKSRLTISKGTSKSQVVLTMTNMDPEDTATYYCARIVGYGSGWYGYFDYWGQGTLVTVSSGGGGSGGGGSGGGGSDIQMTQSPSSLSASVGDRVTITCRASQGIRNDLGWYQQKPGKAPQRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1046 - protein, 7 aa, Artificial Sequence
  Synthetic polypeptide
NARMGVS

SEQ ID NO: 1047 - protein, 16 aa, Artificial Sequence
  Synthetic polypeptide
HIFSNDEKSYSTSLKN

SEQ ID NO: 1048 - protein, 14 aa, Artificial Sequence
  Synthetic polypeptide
IVGYGSGWYGFFDY

SEQ ID NO: 1049 - protein, 11 aa, Artificial Sequence
  Synthetic polypeptide
RASQGIRNDLG

SEQ ID NO: 1050 - protein, 7 aa, Artificial Sequence
  Synthetic polypeptide
AASTLQS

SEQ ID NO: 1051 - protein, 9 aa, Artificial Sequence
  Synthetic polypeptide
LQHNSYPLT

SEQ ID NO: 1052 - protein, 124 aa, Artificial Sequence
  Synthetic polypeptide
QVTLKESGPTLVKPTETLTLTCTLSGFSLNNARMGVSWIRQPPGKALEWLAHIFSNDEKSYSTSLKNRLTISKDSSKTQVVLTMTNVDPVDTATYYCARIVGYGSGWYGFFDYWGQGTLVTVSS

SEQ ID NO: 1053 - protein, 107 aa, Artificial Sequence
  Synthetic polypeptide
DIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGGGTKVEIK

SEQ ID NO: 1054 - protein, 246 aa, Artificial Sequence
  Synthetic polypeptide
QVTLKESGPTLVKPTETLTLTCTLSGFSLNNARMGVSWIRQPPGKALEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGGGTKVEIK

SEQ ID NO: 1055 - protein, 501 aa, Artificial Sequence
  Synthetic polypeptide
QVTLKESGPTLVKPTETLTLTCTLSGFSLNNARMGVSWIRQPPGKALEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1056 - protein, 7 aa, Artificial Sequence
  Synthetic polypeptide
NARMAVS

SEQ ID NO: 1057 - protein, 16 aa, Artificial Sequence
  Synthetic polypeptide
HIFSNDEKSYSTSLKS

SEQ ID NO: 1058 - protein, 14 aa, Artificial Sequence
  Synthetic polypeptide
IVGYGSGWYGYFDY

SEQ ID NO: 1059 - protein, 11 aa, Artificial Sequence
  Synthetic polypeptide
RASQDIRNDLG

SEQ ID NO: 1060 - protein, 7 aa, Artificial Sequence
  Synthetic polypeptide
AASTLQS

SEQ ID NO: 1061 - protein, 9 aa, Artificial Sequence
  Synthetic polypeptide
LQHNSYPLT

SEQ ID NO: 1062 - protein, 124 aa, Artificial Sequence
  Synthetic polypeptide
QVTLKESGPALVKPTETLTLTCTLSGFSLNNARMAVSWIRQPPGKTLEWLAHIFSNDEKSYSTSLKSRLTISKDTSKGQVVLTMTNMDPVDTATYYCARIVGYGSGWYGYFDYWGQGTLVTVSS

SEQ ID NO: 1063 - protein, 107 aa, Artificial Sequence
  Synthetic polypeptide
DIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGGGTKVEIK

SEQ ID NO: 1064 - protein, 246 aa, Artificial Sequence
  Synthetic polypeptide
QVTLKESGPALVKPTETLTLTCTLSGFSLNNARMAVSWIRQPPGKTLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGGGTKVEIK

SEQ ID NO: 1065 - protein, 501 aa, Artificial Sequence
  Synthetic polypeptide
QVTLKESGPALVKPTETLTLTCTLSGFSLNNARMAVSWIRQPPGKTLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYAASTLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1066 - protein, 7 aa, Artificial Sequence
  Synthetic polypeptide
NARMAVS

SEQ ID NO: 1067 - protein, 16 aa, Artificial Sequence
  Synthetic polypeptide
HIFSNDEKSYSTSLKS

SEQ ID NO: 1068 - protein, 14 aa, Artificial Sequence
  Synthetic polypeptide
IVGYGSGWYGYFDY

SEQ ID NO: 1069 - protein, 11 aa, Artificial Sequence
  Synthetic polypeptide
RASQDIGNDLG

SEQ ID NO: 1070 - protein, 7 aa, Artificial Sequence
  Synthetic polypeptide
AASSLQS

SEQ ID NO: 1071 - protein, 9 aa, Artificial Sequence
  Synthetic polypeptide
LQHNSYPLT

SEQ ID NO: 1072 - protein, 124 aa, Artificial Sequence; identical to SEQ ID NO: 1062
  Synthetic polypeptide

SEQ ID NO: 1073 - protein, 107 aa, Artificial Sequence
  Synthetic polypeptide
DIQMTQSPSSLSASVGDRVTITCRASQDIGNDLGWYQQKPGKAPKRLIYAASSLQSGVPSRFSGSGSGTEFTLTISSLQPEDFATYYCLQHNSYPLTFGGGTKVEIK

SEQ ID NO: 1074 - protein, 246 aa, Artificial Sequence
  Synthetic polypeptide
QVTLKESGPALVKPTETLTLTCTLSGFSLNNARMAVSWIRQPPGKTLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIGNDLGWYQQKPGKAPKRLIYAASSLQSGVPSRFSGSGSGTEFTLTISSLQPEDFATYYCLQHNSYPLTFGGGTKVEIK

SEQ ID NO: 1075 - protein, 501 aa, Artificial Sequence
  Synthetic polypeptide
QVTLKESGPALVKPTETLTLTCTLSGFSLNNARMAVSWIRQPPGKTLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQDIGNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1076 - protein, 7 aa, Artificial Sequence
  Synthetic polypeptide
NARMAVS

SEQ ID NO: 1077 - protein, 16 aa, Artificial Sequence
  Synthetic polypeptide
HIFSNDEKSYSTSLKS

SEQ ID NO: 1078 - protein, 14 aa, Artificial Sequence
  Synthetic polypeptide
IVGYGSGWYGYFDY

SEQ ID NO: 1079 - protein, 11 aa, Artificial Sequence
  Synthetic polypeptide
RASQDIRYDLA

SEQ ID NO: 1080 - protein, 7 aa, Artificial Sequence
  Synthetic polypeptide
AASSLQS

SEQ ID NO: 1081 - protein, 9 aa, Artificial Sequence
  Synthetic polypeptide
LQHNFYPLT

SEQ ID NO: 1082 - protein, 124 aa, Artificial Sequence
  Synthetic polypeptide
QVTLKESGPVLVKPTETLTLTCTVSGFSLRNARMAVSWIRQPPGKTLEWLAHIFSNDEKSYSTSLKSRLTISKDTSKSQVVLTMTNMDPVDTATYYCARIVGYGSGWYGYFDYWGQGTLVTVSS

SEQ ID NO: 1083 - protein, 107 aa, Artificial Sequence
  Synthetic polypeptide
DIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGGGTKVEIK

SEQ ID NO: 1084 - protein, 246 aa, Artificial Sequence
  Synthetic polypeptide
QVTLKESGPVLVKPTETLTLTCTVSGFSLRNARMAVSWIRQPPGKTLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGGGTKVEIK

SEQ ID NO: 1085 - protein, 501 aa, Artificial Sequence
  Synthetic polypeptide
QVTLKESGPVLVKPTETLTLTCTVSGFSLRNARMAVSWIRQPPGKTLEWLAHIFSNDEKSYSTSLKSRLTISKDTSKSQVVLTMTNMDPVDTATYYCARIVGYGSGWYGYFDYWGQGTLVTVSSGGGGSGGGGSGGGGSDIQMTQSPSSVSASVGDRVTITCRASQDIRYDLAWYQQKPGKAPKRLIYAASSLQSGVPSRFSGSGSGTEFTLTISSLQPEDFATYYCLQHNFYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1086 - protein, 7 aa, Artificial Sequence
  Synthetic polypeptide
NARMGVS

SEQ ID NO: 1087 - protein, 16 aa, Artificial Sequence
  Synthetic polypeptide
NIFSNDEKSYSTSLKS

SEQ ID NO: 1088 - protein, 14 aa, Artificial Sequence
  Synthetic polypeptide
IVGYGSGWYGYFDY

SEQ ID NO: 1089 - protein, 11 aa, Artificial Sequence
  Synthetic polypeptide
RASQDIRNDLG

SEQ ID NO: 1090 - protein, 7 aa, Artificial Sequence
  Synthetic polypeptide
ATSIRQS

SEQ ID NO: 1091 - protein, 9 aa, Artificial Sequence
  Synthetic polypeptide
LQHNSFPLT

SEQ ID NO: 1092 - protein, 124 aa, Artificial Sequence
  Synthetic polypeptide
QVTLKESGPTLVKPTETLTLTCTVSGFSLSNARMGVSWIRQPPGKALEWLANIFSNDEKSYSTSLKSRLTISKGTSKSQVVLTMTNVNPVDTGTYYCARIVGYGSGWYGYFDYWGQGTLVTVSS

SEQ ID NO: 1093 - protein, 107 aa, Artificial Sequence
  Synthetic polypeptide
DIQMTQSPSSLSASVGDRVTITCRASQDIRNDLGWYQQKPGKAPKRLIYATSIRQSGVPSRFTGSGSGTEFTLTISGLQPEDFATYFCLQHNSFPLTFGGGTKVEIK

SEQ ID NO: 1094 - protein, 246 aa, Artificial Sequence
  Synthetic polypeptide
QVTLKESGPTLVKPTETLTLTCTVSGFSLSNARMGVSWIRQPPGKALEWLANIFSNDEKSYSTSLKSRLTISKGTSKSQVVLTMTNVNPVDTGTYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYATSIRQSGVPSRFTGSGSGTEFTLTISGLQPEDFATYFCLQHNSFPLTFGGGTKVEIK

SEQ ID NO: 1095 - protein, 501 aa, Artificial Sequence
  Synthetic polypeptide
QVTLKESGPTLVKPTETLTLTCTVSGFSLSNARMGVSWIRQPPGKALEWLANIFSNDEKSYSTSLKSRLTISKGTSKSQVVLTMTNVNPVDTGTYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYATSIRQSGVPSRFTGSGSGTEFTLTISGLQPEDFATYFCLQHNSFPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1096 - protein, 7 aa, Artificial Sequence
  Synthetic polypeptide
NARMGVS

SEQ ID NO: 1097 - protein, 16 aa, Artificial Sequence
  Synthetic polypeptide
HIFSNDEKSFSTSLKN

SEQ ID NO: 1098 - protein, 14 aa, Artificial Sequence
  Synthetic polypeptide
MVGYGSGWYAYFDY

SEQ ID NO: 1099 - protein, 11 aa, Artificial Sequence
  Synthetic polypeptide
RASQSISSYLN

SEQ ID NO: 1100 - protein, 7 aa, Artificial Sequence
  Synthetic polypeptide
AASSLQS

SEQ ID NO: 1101 - protein, 9 aa, Artificial Sequence
  Synthetic polypeptide
LQHNSYPLT

SEQ ID NO: 1102 - protein, 124 aa, Artificial Sequence
  Synthetic polypeptide
QVTLKESGPVLVKPTQTLTLTCTFSGFSLSNARMGVSWIRQPPGKALEWLAHIFSNDEKSFSTSLKNRLTISKDTSKSQVVLTMTNMDPVDTATYYCARMVGYGSGWYAYFDYWGQGTQVTVSS

SEQ ID NO: 1103 - protein, 107 aa, Artificial Sequence
  Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGGGTKVEIK

SEQ ID NO: 1104 - protein, 246 aa, Artificial Sequence
  Synthetic polypeptide
QVTLKESGPVLVKPTQTLTLTCTFSGFSLSNARMGVSWIRQPPGKALEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGGGTKVEIK

SEQ ID NO: 1105 - protein, 501 aa, Artificial Sequence
  Synthetic polypeptide
QVTLKESGPVLVKPTQTLTLTCTFSGFSLSNARMGVSWIRQPPGKALEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1106 - protein, 7 aa, Artificial Sequence
  Synthetic polypeptide
YARMGVS

SEQ ID NO: 1107 - protein, 16 aa, Artificial Sequence
  Synthetic polypeptide
QIFSNDEKSYSTSLKS

SEQ ID NO: 1108 - protein, 14 aa, Artificial Sequence
  Synthetic polypeptide
IVGYGTGWYGYFDY

SEQ ID NO: 1109 - protein, 11 aa, Artificial Sequence
  Synthetic polypeptide
RASQDIGDDLG

SEQ ID NO: 1110 - protein, 7 aa, Artificial Sequence
  Synthetic polypeptide
AASTLQS

SEQ ID NO: 1111 - protein, 9 aa, Artificial Sequence
  Synthetic polypeptide
LQHNSYPLT

SEQ ID NO: 1112 - protein, 124 aa, Artificial Sequence
  Synthetic polypeptide
QVTLKESGPTLVKPTETLTLTCTVSGFSLSYARMGVSWIRQPPGKALEWLAQIFSNDEKSYSTSLKSRLTISKDTSKSQVVLTMTDMDPEDTATYYCARIVGYGTGWYGYFDYWGQGTQVTVSS

SEQ ID NO: 1113 - protein, 107 aa, Artificial Sequence
  Synthetic polypeptide
DIQMTQSPSSLSASVGDRVTITCRASQDIGDDLGWYQQKPGKAPKRLIYAASTLQSGVPFRFSGSGSGTDFTLTISSLQPEDFATYYCLQHNSYPLTFGGGTKVEIK

SEQ ID NO: 1114 - protein, 246 aa, Artificial Sequence
  Synthetic polypeptide
QVTLKESGPTLVKPTETLTLTCTVSGFSLSYARMGVSWIRQPPGKALEWLAQIFSNDEKSYSTSLKSRLTISKDTSKSQVVLTMTDMDPEDTATYYCARIVGYGTGWYGYFDYWGQGTQVTVSSGGGGSGGGGSGGGGSDIQMTQSPSSLSASVGDRVTITCRASQDIGDDLGWYQQKPGKAPKRLIYAASTLQSGVPFRFSGSGSGTDFTLTISSLQPEDFATYYCLQHNSYPLTFGGGTKVEIK

SEQ ID NO: 1115 - protein, 501 aa, Artificial Sequence
  Synthetic polypeptide
QVTLKESGPTLVKPTETLTLTCTVSGFSLSYARMGVSWIRQPPGKALEWLAQIFSNDEKSYSTSLKSRLTISKDTSKSQVVLTMTDMDPEDTATYYCARIVGYGTGWYGYFDYWGQGTQVTVSSGGGGSGGGGSGGGGSDIQMTQSPSSLSASVGDRVTITCRASQDIGDDLGWYQQKPGKAPKRLIYAASTLQSGVPFRFSGSGSGTDFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1116 - protein, 7 aa, Artificial Sequence
  Synthetic polypeptide
NARMAVS

SEQ ID NO: 1117 - protein, 16 aa, Artificial Sequence
  Synthetic polypeptide
HIFSNDEKSYSTSLKS

SEQ ID NO: 1118 - protein, 14 aa, Artificial Sequence
  Synthetic polypeptide
IVGYGTGWYGFFDY

SEQ ID NO: 1119 - protein, 11 aa, Artificial Sequence
  Synthetic polypeptide
RASQGIRNDLA

SEQ ID NO: 1120 - protein, 7 aa, Artificial Sequence
  Synthetic polypeptide
AASSLQS

SEQ ID NO: 1121 - protein, 9 aa, Artificial Sequence
  Synthetic polypeptide
LQHNSYPLT

SEQ ID NO: 1122 - protein, 124 aa, Artificial Sequence
  Synthetic polypeptide
QVTLKESGPALVKPTETLTLTCTLSGFSLNNARMAVSWIRQPPGKTLEWLAHIFSNDEKSYSTSLKSRLTISKDTSKSQVVLTMTNMDPEDTATYYCARIVGYGTGWYGFFDYWGQGILVTVSS

SEQ ID NO: 1123 - protein, 107 aa, Artificial Sequence
  Synthetic polypeptide
DIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGGGTKVEIK

SEQ ID NO: 1124 - protein, 246 aa, Artificial Sequence
  Synthetic polypeptide
QVTLKESGPALVKPTETLTLTCTLSGFSLNNARMAVSWIRQPPGKTLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGGGTKVEIK

SEQ ID NO: 1125 - protein, 501 aa, Artificial Sequence
  Synthetic polypeptide
QVTLKESGPALVKPTETLTLTCTLSGFSLNNARMAVSWIRQPPGKTLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1126 - protein, 7 aa, Artificial Sequence
  Synthetic polypeptide
NARMGVS

SEQ ID NO: 1127 - protein, 16 aa, Artificial Sequence
  Synthetic polypeptide
HIFSNDEKSYSTSLKS

SEQ ID NO: 1128 - protein, 17 aa, Artificial Sequence
  Synthetic polypeptide
IPGYGGNFYYHYYGMDV

SEQ ID NO: 1129 - protein, 11 aa, Artificial Sequence
  Synthetic polypeptide
RTSRGIRNDLG

SEQ ID NO: 1130 - protein, 7 aa, Artificial Sequence
  Synthetic polypeptide
AASTLQS

SEQ ID NO: 1131 - protein, 9 aa, Artificial Sequence
  Synthetic polypeptide
LQHNNFPWT

SEQ ID NO: 1132 - protein, 127 aa, Artificial Sequence
  Synthetic polypeptide
QVTLKESGPALVKPTETLTLTCTFSGFSLSNARMGVSWIRQPPGKALEWLAHIFSNDEKSYSTSLKSRLTISKDTSKSQVVLTMTNMDPVDTATYYCARIPGYGGNFYYHYYGMDVWGQGTTVTVSS

SEQ ID NO: 1133 - protein, 107 aa, Artificial Sequence
  Synthetic polypeptide
DIQMTQSPSSLSASVGDRVTITCRTSRGIRNDLGWYQQIPGRAPKRLIYAASTLQSGVPSRFSGSGSGTEFTLTISSLQPEDFATYYCLQHNNFPWTFGQGTKVEIK

SEQ ID NO: 1134 - protein, 249 aa, Artificial Sequence
  Synthetic polypeptide
QVTLKESGPALVKPTETLTLTCTFSGFSLSNARMGVSWIRQPPGKALEWLAHIFSNDEKSYSTSLKSRLTISKDTSKSQVVLTMTNMDPVDTATYYCARIPGYGGNFYYHYYGMDVWGQGTTVTVSSGGGGSGGGGSGGGGSDIQMTQSPSSLSASVGDRVTITCRTSRGIRNDLGWYQQIPGRAPKRLIYAASTLQSGVPSRFSGSGSGTEFTLTISSLQPEDFATYYCLQHNNFPWTFGQGTKVEIK

SEQ ID NO: 1135 - protein, 504 aa, Artificial Sequence
  Synthetic polypeptide
QVTLKESGPALVKPTETLTLTCTFSGFSLSNARMGVSWIRQPPGKALEWLAHIFSNDEKSYSTSLKSRLTISKDTSKSQVVLTMTNMDPVDTATYYCARIPGYGGNFYYHYYGMDVWGQGTTVTVSSGGGGSGGGGSGGGGSDIQMTQSPSSLSASVGDRVTITCRTSRGIRNDLGWYQQIPGRAPKRLIYAASTLQSGVPSRFSGSGSGTEFTLTISSLQPEDFATYYCLQHNNFPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1136 - protein, 7 aa, Artificial Sequence
  Synthetic polypeptide
NARMGVS

SEQ ID NO: 1137 - protein, 16 aa, Artificial Sequence
  Synthetic polypeptide
HIFSNDEKSYSTSLKS

SEQ ID NO: 1138 - protein, 14 aa, Artificial Sequence
  Synthetic polypeptide
MPEYSSGWSGAFDI

SEQ ID NO: 1139 - protein, 11 aa, Artificial Sequence
  Synthetic polypeptide
RASQGISNYLA

SEQ ID NO: 1140 - protein, 7 aa, Artificial Sequence
  Synthetic polypeptide
AASTLQS

SEQ ID NO: 1141 - protein, 9 aa, Artificial Sequence
  Synthetic polypeptide
LQHNTYPWT

SEQ ID NO: 1142 - protein, 124 aa, Artificial Sequence; identical to SEQ ID NO: 1022
  Synthetic polypeptide

SEQ ID NO: 1143 - protein, 107 aa, Artificial Sequence
  Synthetic polypeptide
DIQMTQSPSSLSASVGDRVTITCRASQGISNYLAWYQQKPGKAPKRLIYAASTLQSGVPSRFSGSGSGTEFTLTISSLQPEDFATYYCLQHNTYPWTFGQGTKVEIK

SEQ ID NO: 1144 - protein, 246 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQGISNYLAWYQQKPGKAPKRLIYAASTLQSGVPSRFSGSGSGTEFTLTISSLQPEDFATYYCLQHNTYPWTFGQGTKVEIK

SEQ ID NO: 1145 - protein, 501 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQGISNYLAWYQQKPGKAPKRLIYAASTLQSGVPSRFSGSGSGTEFTLTISSLQPEDFATYYCLQHNTYPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1146 - protein, 7 aa, Artificial Sequence
  Synthetic polypeptide
NARMGVS

SEQ ID NO: 1147 - protein, 16 aa, Artificial Sequence
  Synthetic polypeptide
HIFSNDEKSYSTSLKS

SEQ ID NO: 1148 - protein, 14 aa, Artificial Sequence
  Synthetic polypeptide
MPEYSSGWSGAFDI

SEQ ID NO: 1149 - protein, 11 aa, Artificial Sequence
  Synthetic polypeptide
RASQDIGYDLG

SEQ ID NO: 1150 - protein, 7 aa, Artificial Sequence
  Synthetic polypeptide
AASTLQS

SEQ ID NO: 1151 - protein, 9 aa, Artificial Sequence
  Synthetic polypeptide
LQHNSFPWT

SEQ ID NO: 1152 - protein, 124 aa, Artificial Sequence
  Synthetic polypeptide
QVTLKESGPALVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSS

SEQ ID NO: 1153 - protein, 107 aa, Artificial Sequence
  Synthetic polypeptide
DIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGQGTKVEIK

SEQ ID NO: 1154 - protein, 246 aa, Artificial Sequence
  Synthetic polypeptide
QVTLKESGPALVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGQGTKVEIK

SEQ ID NO: 1155 - protein, 501 aa, Artificial Sequence
  Synthetic polypeptide
QVTLKESGPALVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIGYDLGWYQQKPGKAPKRLIYAASTLQSGVPSRFSGSGSGTEFTLIISSLQPEDFATYYCLQHNSFPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1156 - protein, 7 aa, Artificial Sequence
  Synthetic polypeptide
NVRMGVS

SEQ ID NO: 1157 - protein, 16 aa, Artificial Sequence
  Synthetic polypeptide
HIFSNDEKSYSTSLKS

SEQ ID NO: 1158 - protein, 14 aa, Artificial Sequence
  Synthetic polypeptide
MPEYSSGWSGAFDI

SEQ ID NO: 1159 - protein, 11 aa, Artificial Sequence
  Synthetic polypeptide
RASQDIRDDLV

SEQ ID NO: 1160 - protein, 7 aa, Artificial Sequence
  Synthetic polypeptide
AASTLQS

SEQ ID NO: 1161 - protein, 9 aa, Artificial Sequence
  Synthetic polypeptide
LQHHSYPWT

SEQ ID NO: 1162 - protein, 124 aa, Artificial Sequence
  Synthetic polypeptide
QVTLKESGPALVKPTETLTLTCTVSGFSLRNVRMGVSWIRQPPGKALEWLAHIFSNDEKSYSTSLKSRLTISKDTSKSQVVLILTNMDPVDTATYFCARMPEYSSGWSGAFDIWGQGTMVTVSS

SEQ ID NO: 1163 - protein, 107 aa, Artificial Sequence
  Synthetic polypeptide
DIQMTQSPSSLSASVGDRVTITCRASQDIRDDLVWYQQKPGKAPKRLIYAASTLQSGVPSRFSGSGSGTEFTLTISSLQPEDFATYYCLQHHSYPWTFGQGTKVEIK

SEQ ID NO: 1164 - protein, 246 aa, Artificial Sequence
  Synthetic polypeptide
QVTLKESGPALVKPTETLTLTCTVSGFSLRNVRMGVSWIRQPPGKALEWLAHIFSNDEKSYSTSLKSRLTISKDTSKSQVVLILTNMDPVDTATYFCARMPEYSSGWSGAFDIWGQGTMVTVSSGGGGSGGGGSGGGGSDIQMTQSPSSLSASVGDRVTITCRASQDIRDDLVWYQQKPGKAPKRLIYAASTLQSGVPSRFSGSGSGTEFTLTISSLQPEDFATYYCLQHHSYPWTFGQGTKVEIK

SEQ ID NO: 1165 - protein, 501 aa, Artificial Sequence
  Synthetic polypeptide
QVTLKESGPALVKPTETLTLTCTVSGFSLRNVRMGVSWIRQPPGKALEWLAHIFSNDEKSYSTSLKSRLTISKDTSKSQVVLILTNMDPVDTATYFCARMPEYSSGWSGAFDIWGQGTMVTVSSGGGGSGGGGSGGGGSDIQMTQSPSSLSASVGDRVTITCRASQDIRDDLVWYQQKPGKAPKRLIYAASTLQSGVPSRFSGSGSGTEFTLTISSLQPEDFATYYCLQHHSYPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1166 - protein, 7 aa, Artificial Sequence
  Synthetic polypeptide
NARMGVS

SEQ ID NO: 1167 - protein, 16 aa, Artificial Sequence
  Synthetic polypeptide
HIFSNDEKSYSTSLKS

SEQ ID NO: 1168 - protein, 14 aa, Artificial Sequence
  Synthetic polypeptide
MPEYSSGWSGAFDI

SEQ ID NO: 1169 - protein, 11 aa, Artificial Sequence
  Synthetic polypeptide
RASQDIRDDLG

SEQ ID NO: 1170 - protein, 7 aa, Artificial Sequence
  Synthetic polypeptide
AASTLQS

SEQ ID NO: 1171 - protein, 9 aa, Artificial Sequence
  Synthetic polypeptide
LQHNSFPFT

SEQ ID NO: 1172 - protein, 124 aa, Artificial Sequence; identical to SEQ ID NO: 1152
  Synthetic polypeptide

SEQ ID NO: 1173 - protein, 107 aa, Artificial Sequence
  Synthetic polypeptide
DIQMTQSPSSLSASVGDRVTITCRASQDIRDDLGWYQQKPGKAPKRLIYAASTLQSGVPSRFTGGGSGTEFTLTISSLQPEDFATYYCLQHNSFPFTFGGGTKVEIK

SEQ ID NO: 1174 - protein, 246 aa, Artificial Sequence
  Synthetic polypeptide
QVTLKESGPALVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGKAPKRLIYAASTLQSGVPSRFTGGGSGTEFTLTISSLQPEDFATYYCLQHNSFPFTFGGGTKVEIK

SEQ ID NO: 1175 - protein, 501 aa, Artificial Sequence
  Synthetic polypeptide
QVTLKESGPALVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGKAPKRLIYAASTLQSGVPSRFTGGGSGTEFTLTISSLQPEDFATYYCLQHNSFPFTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1176 - protein, 7 aa, Artificial Sequence
  Synthetic polypeptide
NARMGVS

SEQ ID NO: 1177 - protein, 16 aa, Artificial Sequence
  Synthetic polypeptide
HIFSNDEKSYSTSLKS

SEQ ID NO: 1178 - protein, 14 aa, Artificial Sequence
  Synthetic polypeptide
MPEYSSGWSGAFDI

SEQ ID NO: 1179 - protein, 11 aa, Artificial Sequence
  Synthetic polypeptide
RASQGIRNDLV

SEQ ID NO: 1180 - protein, 7 aa, Artificial Sequence
  Synthetic polypeptide
GTSTLQS

SEQ ID NO: 1181 - protein, 9 aa, Artificial Sequence
  Synthetic polypeptide
LQHNSYPLT

SEQ ID NO: 1182 - protein, 124 aa, Artificial Sequence; identical to SEQ ID NO: 1022
  Synthetic polypeptide

SEQ ID NO: 1183 - protein, 107 aa, Artificial Sequence
  Synthetic polypeptide
DIQMTQSPSSLSASVGDRVTITCRASQGIRNDLVWYQQKPGKAPKRLIYGTSTLQSGVPSRFSGSGSGTEFTLTISSLQPEDFATYYCLQHNSYPLTFGGGTKVEIK

SEQ ID NO: 1184 - protein, 246 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQGIRNDLVWYQQKPGKAPKRLIYGTSTLQSGVPSRFSGSGSGTEFTLTISSLQPEDFATYYCLQHNSYPLTFGGGTKVEIK

SEQ ID NO: 1185 - protein, 501 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQGIRNDLVWYQQKPGKAPKRLIYGTSTLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1186 - protein, 7 aa, Artificial Sequence
  Synthetic polypeptide
NARMGVS

SEQ ID NO: 1187 - protein, 16 aa, Artificial Sequence
  Synthetic polypeptide
HIFSNDEKSYSTSLKS

SEQ ID NO: 1188 - protein, 14 aa, Artificial Sequence
  Synthetic polypeptide
MPEYSSGWSGAFDI

SEQ ID NO: 1189 - protein, 11 aa, Artificial Sequence
  Synthetic polypeptide
RTSQGIRNDLV

SEQ ID NO: 1190 - protein, 7 aa, Artificial Sequence
  Synthetic polypeptide
AASTLQS

SEQ ID NO: 1191 - protein, 9 aa, Artificial Sequence
  Synthetic polypeptide
LQHYSYPLT

SEQ ID NO: 1192 - protein, 124 aa, Artificial Sequence; identical to SEQ ID NO: 1022
  Synthetic polypeptide

SEQ ID NO: 1193 - protein, 107 aa, Artificial Sequence
  Synthetic polypeptide
DIQMTQSPSSLSASVGDRVTITCRTSQGIRNDLVWYQQKPGKAPKRLIYAASTLQSGVPSRFSGSGSGTEFTLTISSLQPEDFATYFCLQHYSYPLTFGGGTKVEIK

SEQ ID NO: 1194 - protein, 246 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRTSQGIRNDLVWYQQKPGKAPKRLIYAASTLQSGVPSRFSGSGSGTEFTLTISSLQPEDFATYFCLQHYSYPLTFGGGTKVEIK

SEQ ID NO: 1195 - protein, 501 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRTSQGIRNDLVWYQQKPGKAPKRLIYAASTLQSGVPSRFSGSGSGTEFTLTISSLQPEDFATYFCLQHYSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1196 - protein, 7 aa, Artificial Sequence
  Synthetic polypeptide
NARMGVS

SEQ ID NO: 1197 - protein, 16 aa, Artificial Sequence
  Synthetic polypeptide
HIFSNDEKSYSTSLKS

SEQ ID NO: 1198 - protein, 14 aa, Artificial Sequence
  Synthetic polypeptide
MPEYSSGWSGAFDI

SEQ ID NO: 1199 - protein, 11 aa, Artificial Sequence
  Synthetic polypeptide
RASQGIGDDLG

SEQ ID NO: 1200 - protein, 7 aa, Artificial Sequence
  Synthetic polypeptide
ATSVLQS

SEQ ID NO: 1201 - protein, 9 aa, Artificial Sequence
  Synthetic polypeptide
LQHNSYPLT

SEQ ID NO: 1202 - protein, 124 aa, Artificial Sequence; identical to SEQ ID NO: 1022
  Synthetic polypeptide

SEQ ID NO: 1203 - protein, 107 aa, Artificial Sequence
  Synthetic polypeptide
DIQMTQSPSSLSASVGDRVTITCRASQGIGDDLGWYQQIPGKAPKRLIYATSVLQSGVPSRFSGSGSGTEFTLTISSLQPEDFATYYCLQHNSYPLTFGGGTKVEIK

SEQ ID NO: 1204 - protein, 246 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQGIGDDLGWYQQIPGKAPKRLIYATSVLQSGVPSRFSGSGSGTEFTLTISSLQPEDFATYYCLQHNSYPLTFGGGTKVEIK

SEQ ID NO: 1205 - protein, 501 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQGIGDDLGWYQQIPGKAPKRLIYATSVLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1206 - protein, 7 aa, Artificial Sequence
  Synthetic polypeptide
NARMGVS

SEQ ID NO: 1207 - protein, 16 aa, Artificial Sequence
  Synthetic polypeptide
HIFSNDEKSYRTSLKS

SEQ ID NO: 1208 - protein, 14 aa, Artificial Sequence
  Synthetic polypeptide
IVGYGSGWYAYFDY

SEQ ID NO: 1209 - protein, 11 aa, Artificial Sequence
  Synthetic polypeptide
RASQGIRNDLG

SEQ ID NO: 1210 - protein, 7 aa, Artificial Sequence
  Synthetic polypeptide
AASSLQS

SEQ ID NO: 1211 - protein, 9 aa, Artificial Sequence
  Synthetic polypeptide
LQHNSYPLT

SEQ ID NO: 1212 - protein, 124 aa, Artificial Sequence
  Synthetic polypeptide
QVTLKESGPALVKPTQTLTLTCTFSGFSLSNARMGVSWIRQPPGKALEWLAHIFSNDEKSYRTSLKSRLTISKDTSKSQVVLTMTNMDPVDTATYYCARIVGYGSGWYAYFDYWGQGTLVTVSS

SEQ ID NO: 1213 - protein, 107 aa, Artificial Sequence
  Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 1214 - protein, 246 aa, Artificial Sequence
  Synthetic polypeptide
QVTLKESGPALVKPTQTLTLTCTFSGFSLSNARMGVSWIRQPPGKALEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 1215 - protein, 501 aa, Artificial Sequence
  Synthetic polypeptide
QVTLKESGPALVKPTQTLTLTCTFSGFSLSNARMGVSWIRQPPGKALEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1216 - protein, 7 aa, Artificial Sequence
  Synthetic polypeptide
NARMGVS

SEQ ID NO: 1217 - protein, 16 aa, Artificial Sequence
  Synthetic polypeptide
LIYWNDDKRYSPSLKS

SEQ ID NO: 1218 - protein, 14 aa, Artificial Sequence
  Synthetic polypeptide
MVGYGSGWYAYFDY

SEQ ID NO: 1219 - protein, 11 aa, Artificial Sequence
  Synthetic polypeptide
RASQGIRNDLG

SEQ ID NO: 1220 - protein, 7 aa, Artificial Sequence
  Synthetic polypeptide
AASSLQS

SEQ ID NO: 1221 - protein, 9 aa, Artificial Sequence
  Synthetic polypeptide
LQHNSYPLT

SEQ ID NO: 1222 - protein, 124 aa, Artificial Sequence
  Synthetic polypeptide
QVTLKESGPVLVKPTQTLTLTCTFSGFSLSNARMGVSWIRQPPGKALEWLALIYWNDDKRYSPSLKSRLTITKDTSKNQVVLTMTNMDPVDTATYYCARMVGYGSGWYAYFDYWGQGTLVTVSS

SEQ ID NO: 1223 - protein, 107 aa, Artificial Sequence; identical to SEQ ID NO: 1213
  Synthetic polypeptide

SEQ ID NO: 1224 - protein, 246 aa, Artificial Sequence
  Synthetic polypeptide
QVTLKESGPVLVKPTQTLTLTCTFSGFSLSNARMGVSWIRQPPGKALEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 1225 - protein, 501 aa, Artificial Sequence
  Synthetic polypeptide
QVTLKESGPVLVKPTQTLTLTCTFSGFSLSNARMGVSWIRQPPGKALEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1226 - protein, 7 aa, Artificial Sequence
  Synthetic polypeptide
NARMGVS

SEQ ID NO: 1227 - protein, 16 aa, Artificial Sequence
  Synthetic polypeptide
HIFSNDEKSYSTSLKS

SEQ ID NO: 1228 - protein, 14 aa, Artificial Sequence
  Synthetic polypeptide
IVGYGTGWYGFFDY

SEQ ID NO: 1229 - protein, 11 aa, Artificial Sequence
  Synthetic polypeptide
RTSQGIRNDLG

SEQ ID NO: 1230 - protein, 7 aa, Artificial Sequence
  Synthetic polypeptide
AASSLQS

SEQ ID NO: 1231 - protein, 9 aa, Artificial Sequence
  Synthetic polypeptide
LQHNSYPLT

SEQ ID NO: 1232 - protein, 124 aa, Artificial Sequence
  Synthetic polypeptide
QVTLKESGPALVKPTQTLTLTCTFSGFSLSNARMGVSWIRQPPGKALEWLAHIFSNDEKSYSTSLKSRLTISKDTSKSQVVLTMTDMDPEDTATYYCARIVGYGTGWYGFFDYWGQGILVTVSS

SEQ ID NO: 1233 - protein, 107 aa, Artificial Sequence
  Synthetic polypeptide
DIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIK

SEQ ID NO: 1234 - protein, 246 aa, Artificial Sequence
  Synthetic polypeptide
QVTLKESGPALVKPTQTLTLTCTFSGFSLSNARMGVSWIRQPPGKALEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIK

SEQ ID NO: 1235 - protein, 501 aa, Artificial Sequence
  Synthetic polypeptide
QVTLKESGPALVKPTQTLTLTCTFSGFSLSNARMGVSWIRQPPGKALEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1236 - protein, 7 aa, Artificial Sequence
  Synthetic polypeptide
NARMGVS

SEQ ID NO: 1237 - protein, 16 aa, Artificial Sequence
  Synthetic polypeptide
HIFSNDEKSYSTSLKS

SEQ ID NO: 1238 - protein, 14 aa, Artificial Sequence
  Synthetic polypeptide
IVGYGSGWYGYFDY

SEQ ID NO: 1239 - protein, 11 aa, Artificial Sequence
  Synthetic polypeptide
RASQGIRNDLV

SEQ ID NO: 1240 - protein, 7 aa, Artificial Sequence
  Synthetic polypeptide
AASTLQS

SEQ ID NO: 1241 - protein, 9 aa, Artificial Sequence
  Synthetic polypeptide
LQHYSYPLT

SEQ ID NO: 1242 - protein, 124 aa, Artificial Sequence
  Synthetic polypeptide
QVTLKESGPTLVKPTETLTLTCTVSGFSFRNARMGVSWIRQPPGKALEWLAHIFSNDEKSYSTSLKSRLTISKDTSKGQVVLTMTNMDPVDTATYYCARIVGYGSGWYGYFDYWGQGTLVTVSS

SEQ ID NO: 1243 - protein, 107 aa, Artificial Sequence
  Synthetic polypeptide
DIQMTQSPSSLSASVGDRVTITCRASQGIRNDLVWYQQKPGKAPKRLIYAASTLQSGVPSRFSGSGSGTEFILTISSLQPEDFATYFCLQHYSYPLTFGGGTKLEIK

SEQ ID NO: 1244 - protein, 246 aa, Artificial Sequence
  Synthetic polypeptide
QVTLKESGPTLVKPTETLTLTCTVSGFSFRNARMGVSWIRQPPGKALEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQGIRNDLVWYQQKPGKAPKRLIYAASTLQSGVPSRFSGSGSGTEFILTISSLQPEDFATYFCLQHYSYPLTFGGGTKLEIK

SEQ ID NO: 1245 - protein, 501 aa, Artificial Sequence
  Synthetic polypeptide
QVTLKESGPTLVKPTETLTLTCTVSGFSFRNARMGVSWIRQPPGKALEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQGIRNDLVWYQQKPGKAPKRLIYAASTLQSGVPSRFSGSGSGTEFILTISSLQPEDFATYFCLQHYSYPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1246 - protein, 7 aa, Artificial Sequence
  Synthetic polypeptide
NARMGVS

SEQ ID NO: 1247 - protein, 16 aa, Artificial Sequence
  Synthetic polypeptide
HIFSNDEKSYSTSLKS

SEQ ID NO: 1248 - protein, 14 aa, Artificial Sequence
  Synthetic polypeptide
IVGYGSGWYGYFDY

SEQ ID NO: 1249 - protein, 11 aa, Artificial Sequence
  Synthetic polypeptide
RASQGIGDDLG

SEQ ID NO: 1250 - protein, 7 aa, Artificial Sequence
  Synthetic polypeptide
ATSVLQS

SEQ ID NO: 1251 - protein, 9 aa, Artificial Sequence
  Synthetic polypeptide
LQHNSYPLT

SEQ ID NO: 1252 - protein, 124 aa, Artificial Sequence
  Synthetic polypeptide
QVTLKESGPVLVKPTETLTLTCTVSGFSLRNARMGVSWIRQPPGKTLEWLAHIFSNDEKSYSTSLKSRLTISKDTSKGQVVLTMTNMDPVDTATYYCARIVGYGSGWYGYFDYWGQGTLVTVSS

SEQ ID NO: 1253 - protein, 107 aa, Artificial Sequence
  Synthetic polypeptide
DIQMTQSPSSLSASVGDRVTITCRASQGIGDDLGWYQQIPGKAPKRLIYATSVLQSGVPSRFSGSGSGTEFTLTISSLQPEDFATYYCLQHNSYPLTFGGGTKLEIK

SEQ ID NO: 1254 - protein, 246 aa, Artificial Sequence
  Synthetic polypeptide
QVTLKESGPVLVKPTETLTLTCTVSGFSLRNARMGVSWIRQPPGKTLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQGIGDDLGWYQQIPGKAPKRLIYATSVLQSGVPSRFSGSGSGTEFTLTISSLQPEDFATYYCLQHNSYPLTFGGGTKLEIK

SEQ ID NO: 1255 - protein, 501 aa, Artificial Sequence
  Synthetic polypeptide
QVTLKESGPVLVKPTETLTLTCTVSGFSLRNARMGVSWIRQPPGKTLEWLAHIFSNDEKSYSTSLKSRLTISKDTSKGQVVLTMTNMDPVDTATYYCARIVGYGSGWYGYFDYWGQGTLVTVSSGGGGSGGGGSGGGGSDIQMTQSPSSLSASVGDRVTITCRASQGIGDDLGWYQQIPGKAPKRLIYATSVLQSGVPSRFSGSGSGTEFTLTISSLQPEDFATYYCLQHNSYPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1256 - protein, 7 aa, Artificial Sequence
  Synthetic polypeptide
NARMGVS

SEQ ID NO: 1257 - protein, 16 aa, Artificial Sequence
  Synthetic polypeptide
HIFWNDEKSYSTSLKS

SEQ ID NO: 1258 - protein, 15 aa, Artificial Sequence
  Synthetic polypeptide
IPYYGSGSYNYGMDV

SEQ ID NO: 1259 - protein, 11 aa, Artificial Sequence
  Synthetic polypeptide
RASQGIRNDLG

SEQ ID NO: 1260 - protein, 7 aa, Artificial Sequence
  Synthetic polypeptide
AASSLQS

SEQ ID NO: 1261 - protein, 9 aa, Artificial Sequence
  Synthetic polypeptide
LQHNSYPLT

SEQ ID NO: 1262 - protein, 125 aa, Artificial Sequence
  Synthetic polypeptide
QVTLKESGPALVKPTETLTLTCTFSGFSLRNARMGVSWIRQPPGKALEWLAHIFWNDEKSYSTSLKSRLTISKDTSKSQVVLTMTNMDPVDTATYYCARIPYYGSGSYNYGMDVWGQGTTVTVSS

SEQ ID NO: 1263 - protein, 107 aa, Artificial Sequence
  Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKLEIK

SEQ ID NO: 1264 - protein, 247 aa, Artificial Sequence
  Synthetic polypeptide
QVTLKESGPALVKPTETLTLTCTFSGFSLRNARMGVSWIRQPPGKALEWLAHIFWNDEKSYSTSLKSRLTISKDTSKSQVVLTMTNMDPVDTATYYCARIPYYGSGSYNYGMDVWGQGTTVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKLEIK

SEQ ID NO: 1265 - protein, 502 aa, Artificial Sequence
  Synthetic polypeptide
QVTLKESGPALVKPTETLTLTCTFSGFSLRNARMGVSWIRQPPGKALEWLAHIFWNDEKSYSTSLKSRLTISKDTSKSQVVLTMTNMDPVDTATYYCARIPYYGSGSYNYGMDVWGQGTTVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1266 - protein, 7 aa, Artificial Sequence
  Synthetic polypeptide
NARMGVS

SEQ ID NO: 1267 - protein, 16 aa, Artificial Sequence
  Synthetic polypeptide
HIFSNDEKSYSTSLKN

SEQ ID NO: 1268 - protein, 14 aa, Artificial Sequence
  Synthetic polypeptide
IVGYGTGWYGFFDY

SEQ ID NO: 1269 - protein, 11 aa, Artificial Sequence
  Synthetic polypeptide
RASQDIRDDLV

SEQ ID NO: 1270 - protein, 7 aa, Artificial Sequence
  Synthetic polypeptide
GTSTLQS

SEQ ID NO: 1271 - protein, 9 aa, Artificial Sequence
  Synthetic polypeptide
LQHHSYPLT

SEQ ID NO: 1272 - protein, 124 aa, Artificial Sequence
  Synthetic polypeptide
QVTLKESGPALVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWYGFFDYWGQGTQVTVSS

SEQ ID NO: 1273 - protein, 107 aa, Artificial Sequence
  Synthetic polypeptide
DIQMTQSPSSLSASVGDRVTITCRASQDIRDDLVWYQQKPGKAPKRLIYGTSTLQSGVPSRFSGSGSGTEFTLTISSLQPEDFATYYCLQHHSYPLTFGGGTKLEIK

SEQ ID NO: 1274 - protein, 246 aa, Artificial Sequence
  Synthetic polypeptide
QVTLKESGPALVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWYGFFDYWGQGTQVTVSSGGGGSGGGGSGGGGSDIQMTQSPSSLSASVGDRVTITCRASQDIRDDLVWYQQKPGKAPKRLIYGTSTLQSGVPSRFSGSGSGTEFTLTISSLQPEDFATYYCLQHHSYPLTFGGGTKLEIK

SEQ ID NO: 1275 - protein, 501 aa, Artificial Sequence
  Synthetic polypeptide
QVTLKESGPALVKPTETLTLTCTVSGFSLNNARMGVSWIRQPPGKALEWLAHIFSNDEKSYSTSLKNRLTISKDSSKTQVVLTMTNVDPVDTATYYCARIVGYGTGWYGFFDYWGQGTQVTVSSGGGGSGGGGSGGGGSDIQMTQSPSSLSASVGDRVTITCRASQDIRDDLVWYQQKPGKAPKRLIYGTSTLQSGVPSRFSGSGSGTEFTLTISSLQPEDFATYYCLQHHSYPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1276 - protein, 7 aa, Artificial Sequence
  Synthetic polypeptide
YARMGVS

SEQ ID NO: 1277 - protein, 16 aa, Artificial Sequence
  Synthetic polypeptide
HIFSNDEKSYSTSLKS

SEQ ID NO: 1278 - protein, 14 aa, Artificial Sequence
  Synthetic polypeptide
MPEYSSGWSGAFDI

SEQ ID NO: 1279 - protein, 11 aa, Artificial Sequence
  Synthetic polypeptide
RASQDIRNDLA

SEQ ID NO: 1280 - protein, 7 aa, Artificial Sequence
  Synthetic polypeptide
AASSLQS

SEQ ID NO: 1281 - protein, 9 aa, Artificial Sequence
  Synthetic polypeptide
LQHNSYPLT

SEQ ID NO: 1282 - protein, 124 aa, Artificial Sequence
  Synthetic polypeptide
QVTLKESGPTLVKPTETLTLTCTFSGFSLRYARMGVSWIRQPPGKALEWLAHIFSNDEKSYSTSLKSRLTISKDTSKSQVVLTLTNMDPVDTATYFCARMPEYSSGWSGAFDIWGQGTMVTVSS

SEQ ID NO: 1283 - protein, 107 aa, Artificial Sequence
  Synthetic polypeptide
DIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGGGTKLEIK

SEQ ID NO: 1284 - protein, 246 aa, Artificial Sequence
  Synthetic polypeptide
QVTLKESGPTLVKPTETLTLTCTFSGFSLRYARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGGGTKLEIK

SEQ ID NO: 1285 - protein, 501 aa, Artificial Sequence
  Synthetic polypeptide
QVTLKESGPTLVKPTETLTLTCTFSGFSLRYARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1286 - protein, 7 aa, Artificial Sequence
  Synthetic polypeptide
NIKMGVS

SEQ ID NO: 1287 - protein, 16 aa, Artificial Sequence
  Synthetic polypeptide
HIFSNDEKSYSTSLKS

SEQ ID NO: 1288 - protein, 14 aa, Artificial Sequence
  Synthetic polypeptide
MPEYSSGWSGAFDI

SEQ ID NO: 1289 - protein, 11 aa, Artificial Sequence
  Synthetic polypeptide
RASQDISNYLA

SEQ ID NO: 1290 - protein, 7 aa, Artificial Sequence
  Synthetic polypeptide
AASSLQS

SEQ ID NO: 1291 - protein, 9 aa, Artificial Sequence
  Synthetic polypeptide
LQHNSFPLT

SEQ ID NO: 1292 - protein, 124 aa, Artificial Sequence
  Synthetic polypeptide
QVTLKESGPVLVKPTETLTLTCTVSGFSLRNIKMGVSWIRQPPGKALEWLAHIFSNDEKSYSTSLKSRLTISKDTSKSQVVLTLTNMDPVDTATYFCARMPEYSSGWSGAFDIWGQGTMVTVSS

SEQ ID NO: 1293 - protein, 107 aa, Artificial Sequence
  Synthetic polypeptide
DIQMTQSPSSLSASVGDRVTITCRASQDISNYLAWYQQKPGKAPKRLIYAASSLQSGVPSRFSGSGSGTEFTLTISSLQPEDFATYYCLQHNSFPLTFGGGTKLEIK

SEQ ID NO: 1294 - protein, 246 aa, Artificial Sequence
  Synthetic polypeptide
QVTLKESGPVLVKPTETLTLTCTVSGFSLRNIKMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDISNYLAWYQQKPGKAPKRLIYAASSLQSGVPSRFSGSGSGTEFTLTISSLQPEDFATYYCLQHNSFPLTFGGGTKLEIK

SEQ ID NO: 1295 - protein, 501 aa, Artificial Sequence
  Synthetic polypeptide
QVTLKESGPVLVKPTETLTLTCTVSGFSLRNIKMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDISNYLAWYQQKPGKAPKRLIYAASSLQSGVPSRFSGSGSGTEFTLTISSLQPEDFATYYCLQHNSFPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1296 - protein, 7 aa, Artificial Sequence
  Synthetic polypeptide
NARMGVS

SEQ ID NO: 1297 - protein, 16 aa, Artificial Sequence
  Synthetic polypeptide
HIFSNDEKSYSTSLKS

SEQ ID NO: 1298 - protein, 14 aa, Artificial Sequence
  Synthetic polypeptide
MPEYSSGWSGAFDI

SEQ ID NO: 1299 - protein, 11 aa, Artificial Sequence
  Synthetic polypeptide
RASQGIRNDLG

SEQ ID NO: 1300 - protein, 7 aa, Artificial Sequence
  Synthetic polypeptide
AASSLQS

SEQ ID NO: 1301 - protein, 9 aa, Artificial Sequence
  Synthetic polypeptide
LQHNSYPLT

SEQ ID NO: 1302 - protein, 124 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTLVTVSS

SEQ ID NO: 1303 - protein, 107 aa, Artificial Sequence; identical to SEQ ID NO: 1263
  Synthetic polypeptide

SEQ ID NO: 1304 - protein, 246 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKLEIK

SEQ ID NO: 1305 - protein, 501 aa, Artificial Sequence
  Synthetic polypeptide
QVTLKESGPVLVKPTETLTLTCTVSGFSFRNARMGVSWIRQPPGKALEWLAHIFSNDEKSYSTSLKSRLTISKDTSKSQVVLTLTNMDPVDTATYFCARMPEYSSGWSGAFDIWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1306 - protein, 7 aa, Artificial Sequence
  Synthetic polypeptide
NARMGVS

SEQ ID NO: 1307 - protein, 16 aa, Artificial Sequence
  Synthetic polypeptide
HIFSNDEKSYSTSLKN

SEQ ID NO: 1308 - protein, 14 aa, Artificial Sequence
  Synthetic polypeptide
IVGYGSGWYGFFDY

SEQ ID NO: 1309 - protein, 11 aa, Artificial Sequence
  Synthetic polypeptide
RASQGIRNDLG

SEQ ID NO: 1310 - protein, 7 aa, Artificial Sequence
  Synthetic polypeptide
AASTLQS

SEQ ID NO: 1311 - protein, 9 aa, Artificial Sequence
  Synthetic polypeptide
LQHNSYPLT

SEQ ID NO: 1312 - protein, 124 aa, Artificial Sequence
  Synthetic polypeptide
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSS

SEQ ID NO: 1313 - protein, 107 aa, Artificial Sequence
  Synthetic polypeptide
DIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIK

SEQ ID NO: 1314 - protein, 246 aa, Artificial Sequence
  Synthetic polypeptide
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIK

SEQ ID NO: 1315 - protein, 501 aa, Artificial Sequence
  Synthetic polypeptide
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1316 - protein, 7 aa, Artificial Sequence
  Synthetic polypeptide
NARMGVS

SEQ ID NO: 1317 - protein, 16 aa, Artificial Sequence
  Synthetic polypeptide
NIFSNDEKSYSTSLKS

SEQ ID NO: 1318 - protein, 14 aa, Artificial Sequence
  Synthetic polypeptide
IVGYGSGWYGYFDY

SEQ ID NO: 1319 - protein, 11 aa, Artificial Sequence
  Synthetic polypeptide
RASQDIRNDLG

SEQ ID NO: 1320 - protein, 7 aa, Artificial Sequence
  Synthetic polypeptide
ATSIRQS

SEQ ID NO: 1321 - protein, 9 aa, Artificial Sequence
  Synthetic polypeptide
LQHNSFPLT

SEQ ID NO: 1322 - protein, 124 aa, Artificial Sequence
  Synthetic polypeptide
QVTLKESGPTLVKPTETLTLTCTVSGFSLSNARMGVSWIRQPPGKCLEWLANIFSNDEKSYSTSLKSRLTISKGTSKSQVVLTMTNVNPVDTGTYYCARIVGYGSGWYGYFDYWGQGTLVTVSS

SEQ ID NO: 1323 - protein, 107 aa, Artificial Sequence
  Synthetic polypeptide
DIQMTQSPSSLSASVGDRVTITCRASQDIRNDLGWYQQKPGKAPKRLIYATSIRQSGVPSRFTGSGSGTEFTLTISGLQPEDFATYFCLQHNSFPLTFGCGTKVEIK

SEQ ID NO: 1324 - protein, 246 aa, Artificial Sequence
  Synthetic polypeptide
QVTLKESGPTLVKPTETLTLTCTVSGFSLSNARMGVSWIRQPPGKCLEWLANIFSNDEKSYSTSLKSRLTISKGTSKSQVVLTMTNVNPVDTGTYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYATSIRQSGVPSRFTGSGSGTEFTLTISGLQPEDFATYFCLQHNSFPLTFGCGTKVEIK

SEQ ID NO: 1325 - protein, 501 aa, Artificial Sequence
  Synthetic polypeptide
QVTLKESGPTLVKPTETLTLTCTVSGFSLSNARMGVSWIRQPPGKCLEWLANIFSNDEKSYSTSLKSRLTISKGTSKSQVVLTMTNVNPVDTGTYYCARIVGYGSGWYGYFDYWGQGTLVTVSSGGGGSGGGGSGGGGSDIQMTQSPSSLSASVGDRVTITCRASQDIRNDLGWYQQKPGKAPKRLIYATSIRQSGVPSRFTGSGSGTEFTLTISGLQPEDFATYFCLQHNSFPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1326 - protein, 7 aa, Artificial Sequence
  Synthetic polypeptide
NARMGVS

SEQ ID NO: 1327 - protein, 16 aa, Artificial Sequence
  Synthetic polypeptide
HIFSNDEKSFSTSLKN

SEQ ID NO: 1328 - protein, 14 aa, Artificial Sequence
  Synthetic polypeptide
MVGYGSGWYAYFDY

SEQ ID NO: 1329 - protein, 11 aa, Artificial Sequence
  Synthetic polypeptide
RASQSISSYLN

SEQ ID NO: 1330 - protein, 7 aa, Artificial Sequence
  Synthetic polypeptide
AASSLQS

SEQ ID NO: 1331 - protein, 9 aa, Artificial Sequence
  Synthetic polypeptide
LQHNSYPLT

SEQ ID NO: 1332 - protein, 124 aa, Artificial Sequence
  Synthetic polypeptide
QVTLKESGPVLVKPTQTLTLTCTFSGFSLSNARMGVSWIRQPPGKCLEWLAHIFSNDEKSFSTSLKNRLTISKDTSKSQVVLTMTNMDPVDTATYYCARMVGYGSGWYAYFDYWGQGTQVTVSS

SEQ ID NO: 1333 - protein, 107 aa, Artificial Sequence
  Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGCGTKVEIK

SEQ ID NO: 1334 - protein, 246 aa, Artificial Sequence
  Synthetic polypeptide
QVTLKESGPVLVKPTQTLTLTCTFSGFSLSNARMGVSWIRQPPGKCLEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGCGTKVEIK

SEQ ID NO: 1335 - protein, 501 aa, Artificial Sequence
  Synthetic polypeptide
QVTLKESGPVLVKPTQTLTLTCTFSGFSLSNARMGVSWIRQPPGKCLEWLAHIFSNDEKSFSTSLKNRLTISKDTSKSQVVLTMTNMDPVDTATYYCARMVGYGSGWYAYFDYWGQGTQVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1336 - protein, 7 aa, Artificial Sequence
  Synthetic polypeptide
NARMAVS

SEQ ID NO: 1337 - protein, 16 aa, Artificial Sequence
  Synthetic polypeptide
HIFSNDEKSYSTSLKS

SEQ ID NO: 1338 - protein, 14 aa, Artificial Sequence
  Synthetic polypeptide
IVGYGTGWYGFFDY

SEQ ID NO: 1339 - protein, 11 aa, Artificial Sequence
  Synthetic polypeptide
RASQGIRNDLA

SEQ ID NO: 1340 - protein, 7 aa, Artificial Sequence
  Synthetic polypeptide
AASSLQS

SEQ ID NO: 1341 - protein, 9 aa, Artificial Sequence
  Synthetic polypeptide
LQHNSYPLT

SEQ ID NO: 1342 - protein, 124 aa, Artificial Sequence
  Synthetic polypeptide
QVTLKESGPALVKPTETLTLTCTLSGFSLNNARMAVSWIRQPPGKCLEWLAHIFSNDEKSYSTSLKSRLTISKDTSKSQVVLTMTNMDPEDTATYYCARIVGYGTGWYGFFDYWGQGILVTVSS

SEQ ID NO: 1343 - protein, 107 aa, Artificial Sequence
  Synthetic polypeptide
DIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGCGTKVEIK

SEQ ID NO: 1344 - protein, 246 aa, Artificial Sequence
  Synthetic polypeptide
QVTLKESGPALVKPTETLTLTCTLSGFSLNNARMAVSWIRQPPGKCLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGCGTKVEIK

SEQ ID NO: 1345 - protein, 501 aa, Artificial Sequence
  Synthetic polypeptide
QVTLKESGPALVKPTETLTLTCTLSGFSLNNARMAVSWIRQPPGKCLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1346 - protein, 7 aa, Artificial Sequence
  Synthetic polypeptide
NARMGVS

SEQ ID NO: 1347 - protein, 16 aa, Artificial Sequence
  Synthetic polypeptide
HIFSNDEKSYSTSLKS

SEQ ID NO: 1348 - protein, 14 aa, Artificial Sequence
  Synthetic polypeptide
MPEYSSGWSGAFDI

SEQ ID NO: 1349 - protein, 11 aa, Artificial Sequence
  Synthetic polypeptide
RASQGIRNDLV

SEQ ID NO: 1350 - protein, 7 aa, Artificial Sequence
  Synthetic polypeptide
GTSTLQS

SEQ ID NO: 1351 - protein, 9 aa, Artificial Sequence
  Synthetic polypeptide
LQHNSYPLT

SEQ ID NO: 1352 - protein, 124 aa, Artificial Sequence
  Synthetic polypeptide
QVTLKESGPVLVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSS

SEQ ID NO: 1353 - protein, 107 aa, Artificial Sequence
  Synthetic polypeptide
DIQMTQSPSSLSASVGDRVTITCRASQGIRNDLVWYQQKPGKAPKRLIYGTSTLQSGVPSRFSGSGSGTEFTLTISSLQPEDFATYYCLQHNSYPLTFGCGTKVEIK

SEQ ID NO: 1354 - protein, 246 aa, Artificial Sequence
  Synthetic polypeptide
QVTLKESGPVLVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQGIRNDLVWYQQKPGKAPKRLIYGTSTLQSGVPSRFSGSGSGTEFTLTISSLQPEDFATYYCLQHNSYPLTFGCGTKVEIK

SEQ ID NO: 1355 - protein, 501 aa, Artificial Sequence
  Synthetic polypeptide
QVTLKESGPVLVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQGIRNDLVWYQQKPGKAPKRLIYGTSTLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1356 - protein, 7 aa, Artificial Sequence
  Synthetic polypeptide
NARMGVS

SEQ ID NO: 1357 - protein, 16 aa, Artificial Sequence
  Synthetic polypeptide
HIFSNDEKSYSTSLKS

SEQ ID NO: 1358 - protein, 14 aa, Artificial Sequence
  Synthetic polypeptide
MPEYSSGWSGAFDI

SEQ ID NO: 1359 - protein, 11 aa, Artificial Sequence
  Synthetic polypeptide
RTSQGIRNDLV

SEQ ID NO: 1360 - protein, 7 aa, Artificial Sequence
  Synthetic polypeptide
AASTLQS

SEQ ID NO: 1361 - protein, 9 aa, Artificial Sequence
  Synthetic polypeptide
LQHYSYPLT

SEQ ID NO: 1362 - protein, 124 aa, Artificial Sequence; identical to SEQ ID NO: 1352
  Synthetic polypeptide

SEQ ID NO: 1363 - protein, 107 aa, Artificial Sequence
  Synthetic polypeptide
DIQMTQSPSSLSASVGDRVTITCRTSQGIRNDLVWYQQKPGKAPKRLIYAASTLQSGVPSRFSGSGSGTEFTLTISSLQPEDFATYFCLQHYSYPLTFGCGTKVEIK

SEQ ID NO: 1364 - protein, 246 aa, Artificial Sequence
  Synthetic polypeptide
QVTLKESGPVLVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRTSQGIRNDLVWYQQKPGKAPKRLIYAASTLQSGVPSRFSGSGSGTEFTLTISSLQPEDFATYFCLQHYSYPLTFGCGTKVEIK

SEQ ID NO: 1365 - protein, 501 aa, Artificial Sequence
  Synthetic polypeptide
QVTLKESGPVLVKPTETLTLTCTVSGFSFRNARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRTSQGIRNDLVWYQQKPGKAPKRLIYAASTLQSGVPSRFSGSGSGTEFTLTISSLQPEDFATYFCLQHYSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1366 - protein, 7 aa, Artificial Sequence
  Synthetic polypeptide
NARMGVS

SEQ ID NO: 1367 - protein, 16 aa, Artificial Sequence
  Synthetic polypeptide
HIFSNDEKSYRTSLKS

SEQ ID NO: 1368 - protein, 14 aa, Artificial Sequence
  Synthetic polypeptide
IVGYGSGWYAYFDY

SEQ ID NO: 1369 - protein, 11 aa, Artificial Sequence
  Synthetic polypeptide
RASQGIRNDLG

SEQ ID NO: 1370 - protein, 7 aa, Artificial Sequence
  Synthetic polypeptide
AASSLQS

SEQ ID NO: 1371 - protein, 9 aa, Artificial Sequence
  Synthetic polypeptide
LQHNSYPLT

SEQ ID NO: 1372 - protein, 124 aa, Artificial Sequence
  Synthetic polypeptide
QVTLKESGPALVKPTQTLTLTCTFSGFSLSNARMGVSWIRQPPGKCLEWLAHIFSNDEKSYRTSLKSRLTISKDTSKSQVVLTMTNMDPVDTATYYCARIVGYGSGWYAYFDYWGQGTLVTVSS

SEQ ID NO: 1373 - protein, 107 aa, Artificial Sequence
  Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIK

SEQ ID NO: 1374 - protein, 246 aa, Artificial Sequence
  Synthetic polypeptide
QVTLKESGPALVKPTQTLTLTCTFSGFSLSNARMGVSWIRQPPGKCLEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIK

SEQ ID NO: 1375 - protein, 501 aa, Artificial Sequence
  Synthetic polypeptide
QVTLKESGPALVKPTQTLTLTCTFSGFSLSNARMGVSWIRQPPGKCLEWLAHIFSNDEKSYRTSLKSRLTISKDTSKSQVVLTMTNMDPVDTATYYCARIVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1376 - protein, 7 aa, Artificial Sequence
  Synthetic polypeptide
NARMGVS

SEQ ID NO: 1377 - protein, 16 aa, Artificial Sequence
  Synthetic polypeptide
LIYWNDDKRYSPSLKS

SEQ ID NO: 1378 - protein, 14 aa, Artificial Sequence
  Synthetic polypeptide
MVGYGSGWYAYFDY

SEQ ID NO: 1379 - protein, 11 aa, Artificial Sequence
  Synthetic polypeptide
RASQGIRNDLG

SEQ ID NO: 1380 - protein, 7 aa, Artificial Sequence
  Synthetic polypeptide
AASSLQS

SEQ ID NO: 1381 - protein, 9 aa, Artificial Sequence
  Synthetic polypeptide
LQHNSYPLT

SEQ ID NO: 1382 - protein, 124 aa, Artificial Sequence
  Synthetic polypeptide
QVTLKESGPVLVKPTQTLTLTCTFSGFSLSNARMGVSWIRQPPGKCLEWLALIYWNDDKRYSPSLKSRLTITKDTSKNQVVLTMTNMDPVDTATYYCARMVGYGSGWYAYFDYWGQGTLVTVSS

SEQ ID NO: 1383 - protein, 107 aa, Artificial Sequence; identical to SEQ ID NO: 1373
  Synthetic polypeptide

SEQ ID NO: 1384 - protein, 246 aa, Artificial Sequence
  Synthetic polypeptide
QVTLKESGPVLVKPTQTLTLTCTFSGFSLSNARMGVSWIRQPPGKCLEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIK

SEQ ID NO: 1385 - protein, 501 aa, Artificial Sequence
  Synthetic polypeptide
QVTLKESGPVLVKPTQTLTLTCTFSGFSLSNARMGVSWIRQPPGKCLEWLALIYWNDDKRYSPSLKSRLTITKDTSKNQVVLTMTNMDPVDTATYYCARMVGYGSGWYAYFDYWGQGTLVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1386 - protein, 7 aa, Artificial Sequence
  Synthetic polypeptide
NARMGVS

SEQ ID NO: 1387 - protein, 16 aa, Artificial Sequence
  Synthetic polypeptide
HIFSNDEKSYSTSLKS

SEQ ID NO: 1388 - protein, 14 aa, Artificial Sequence
  Synthetic polypeptide
IVGYGTGWYGFFDY

SEQ ID NO: 1389 - protein, 11 aa, Artificial Sequence
  Synthetic polypeptide
RTSQGIRNDLG

SEQ ID NO: 1390 - protein, 7 aa, Artificial Sequence
  Synthetic polypeptide
AASSLQS

SEQ ID NO: 1391 - protein, 9 aa, Artificial Sequence
  Synthetic polypeptide
LQHNSYPLT

SEQ ID NO: 1392 - protein, 124 aa, Artificial Sequence
  Synthetic polypeptide
QVTLKESGPALVKPTQTLTLTCTFSGFSLSNARMGVSWIRQPPGKCLEWLAHIFSNDEKSYSTSLKSRLTISKDTSKSQVVLTMTDMDPEDTATYYCARIVGYGTGWYGFFDYWGQGILVTVSS

SEQ ID NO: 1393 - protein, 107 aa, Artificial Sequence
  Synthetic polypeptide
DIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGCGTKVEIK

SEQ ID NO: 1394 - protein, 246 aa, Artificial Sequence
  Synthetic polypeptide
QVTLKESGPALVKPTQTLTLTCTFSGFSLSNARMGVSWIRQPPGKCLEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGCGTKVEIK

SEQ ID NO: 1395 - protein, 501 aa, Artificial Sequence
  Synthetic polypeptide
QVTLKESGPALVKPTQTLTLTCTFSGFSLSNARMGVSWIRQPPGKCLEWLAHIFSNDEKSYSTSLKSRLTISKDTSKSQVVLTMTDMDPEDTATYYCARIVGYGTGWYGFFDYWGQGILVTVSSGGGGSGGGGSGGGGSDIQMTQSPSSLSASVGDRVTITCRTSQGIRNDLGWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1396 - protein, 7 aa, Artificial Sequence
  Synthetic polypeptide
NARMGVS

SEQ ID NO: 1397 - protein, 16 aa, Artificial Sequence
  Synthetic polypeptide
HIFWNDEKSYSTSLKS

SEQ ID NO: 1398 - protein, 15 aa, Artificial Sequence
  Synthetic polypeptide
IPYYGSGSYNYGMDV

SEQ ID NO: 1399 - protein, 11 aa, Artificial Sequence
  Synthetic polypeptide
RASQGIRNDLG

SEQ ID NO: 1400 - protein, 7 aa, Artificial Sequence
  Synthetic polypeptide
AASSLQS

SEQ ID NO: 1401 - protein, 9 aa, Artificial Sequence
  Synthetic polypeptide
LQHNTYPLT

SEQ ID NO: 1402 - protein, 125 aa, Artificial Sequence
  Synthetic polypeptide
QVTLKESGPMLVKPTETLTLTCTFSGFSLRNARMGVSWIRQPPGKCLEWLAHIFWNDEKSYSTSLKSRLTISKDTSKSQVVLTMTNMDPVDTATYYCARIPYYGSGSYNYGMDVWGQGTTVTVSS

SEQ ID NO: 1403 - protein, 107 aa, Artificial Sequence
  Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNTYPLTFGCGTKVDIK

SEQ ID NO: 1404 - protein, 247 aa, Artificial Sequence
  Synthetic polypeptide
QVTLKESGPMLVKPTETLTLTCTFSGFSLRNARMGVSWIRQPPGKCLEWLAHIFWNDEKSYSTSLKSRLTISKDTSKSQVVLTMTNMDPVDTATYYCARIPYYGSGSYNYGMDVWGQGTTVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNTYPLTFGCGTKVDIK

SEQ ID NO: 1405 - protein, 502 aa, Artificial Sequence
  Synthetic polypeptide
QVTLKESGPMLVKPTETLTLTCTFSGFSLRNARMGVSWIRQPPGKCLEWLAHIFWNDEKSYSTSLKSRLTISKDTSKSQVVLTMTNMDPVDTATYYCARIPYYGSGSYNYGMDVWGQGTTVTVSSGGGGSGGGGSGGGGSDIQMTQSPSSLSASVGDRVTITCRASQGIRNDLGWYQQKPGKAPKRLIYAASSLQSGVPSRFSGSGSGTEFTLTISSLQPEDFATYYCLQHNTYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1406 - protein, 7 aa, Artificial Sequence
  Synthetic polypeptide
NARMGVS

SEQ ID NO: 1407 - protein, 16 aa, Artificial Sequence
  Synthetic polypeptide
HIFSNDEKSYSTSLKN

SEQ ID NO: 1408 - protein, 14 aa, Artificial Sequence
  Synthetic polypeptide
IVGYGTGWFGYFDY

SEQ ID NO: 1409 - protein, 11 aa, Artificial Sequence
  Synthetic polypeptide
RASQDIRTDLA

SEQ ID NO: 1410 - protein, 7 aa, Artificial Sequence
  Synthetic polypeptide
AASSLQS

SEQ ID NO: 1411 - protein, 9 aa, Artificial Sequence
  Synthetic polypeptide
LQHNRYPLT

SEQ ID NO: 1412 - protein, 124 aa, Artificial Sequence
  Synthetic polypeptide
QVTLKESGPTLVKPTETLTLTCTVSGFSLNNARMGVSWIRQPPGKCLEWLAHIFSNDEKSYSTSLKNRLTISKDSSKTQVVLTMTNVDPVDTATYYCARIVGYGTGWFGYFDYWGQGTQVTVSS

SEQ ID NO: 1413 - protein, 107 aa, Artificial Sequence
  Synthetic polypeptide
DIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGCGTKVDIK

SEQ ID NO: 1414 - protein, 246 aa, Artificial Sequence
  Synthetic polypeptide
QVTLKESGPTLVKPTETLTLTCTVSGFSLNNARMGVSWIRQPPGKCLEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGCGTKVDIK

SEQ ID NO: 1415 - protein, 501 aa, Artificial Sequence
  Synthetic polypeptide
QVTLKESGPTLVKPTETLTLTCTVSGFSLNNARMGVSWIRQPPGKCLEWLAHIFSNDEKSYSTSLKNRLTISKDSSKTQVVLTMTNVDPVDTATYYCARIVGYGTGWFGYFDYWGQGTQVTVSSGGGGSGGGGSGGGGSDIQMTQSPSSLSASVGDRVTITCRASQDIRTDLAWYQQKPGKAPKRLIYAASSLQSGVPSRFSGSGSGTEFTLTISSLQPEDFATYYCLQHNRYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1416 - protein, 7 aa, Artificial Sequence
  Synthetic polypeptide
NARMGVS

SEQ ID NO: 1417 - protein, 16 aa, Artificial Sequence
  Synthetic polypeptide
HIFSNDEKSYSTSLKS

SEQ ID NO: 1418 - protein, 17 aa, Artificial Sequence
  Synthetic polypeptide
IPGYGGNFYYHYYGMDV

SEQ ID NO: 1419 - protein, 11 aa, Artificial Sequence
  Synthetic polypeptide
RASQGIRNDLA

SEQ ID NO: 1420 - protein, 7 aa, Artificial Sequence
  Synthetic polypeptide
AASTVQS

SEQ ID NO: 1421 - protein, 9 aa, Artificial Sequence
  Synthetic polypeptide
LQHNSFPWT

SEQ ID NO: 1422 - protein, 127 aa, Artificial Sequence
  Synthetic polypeptide
QVTLKESGPTLVKPTETLTLTCTVSGFSLSNARMGVSWIRQPPGKCLEWLAHIFSNDEKSYSTSLKSRLTISKDTSKSQVVLTMTNMDPVDTATYYCARIPGYGGNFYYHYYGMDVWGQGTTVTVSS

SEQ ID NO: 1423 - protein, 107 aa, Artificial Sequence
  Synthetic polypeptide
DIQMTQSPSSLSASVGDRVTITCRASQGIRNDLAWYQQKPGKAPKRLIYAASTVQSGVPSRFSGSGSGTEFALTISSLQPEDFATYYCLQHNSFPWTFGCGTKVDIK

SEQ ID NO: 1424 - protein, 249 aa, Artificial Sequence
  Synthetic polypeptide
QVTLKESGPTLVKPTETLTLTCTVSGFSLSNARMGVSWIRQPPGKCLEWLAHIFSNDEKSYSTSLKSRLTISKDTSKSQVVLTMTNMDPVDTATYYCARIPGYGGNFYYHYYGMDVWGQGTTVTVSSGGGGSGGGGSGGGGSDIQMTQSPSSLSASVGDRVTITCRASQGIRNDLAWYQQKPGKAPKRLIYAASTVQSGVPSRFSGSGSGTEFALTISSLQPEDFATYYCLQHNSFPWTFGCGTKVDIK

SEQ ID NO: 1425 - protein, 504 aa, Artificial Sequence
  Synthetic polypeptide
QVTLKESGPTLVKPTETLTLTCTVSGFSLSNARMGVSWIRQPPGKCLEWLAHIFSNDEKSYSTSLKSRLTISKDTSKSQVVLTMTNMDPVDTATYYCARIPGYGGNFYYHYYGMDVWGQGTTVTVSSGGGGSGGGGSGGGGSDIQMTQSPSSLSASVGDRVTITCRASQGIRNDLAWYQQKPGKAPKRLIYAASTVQSGVPSRFSGSGSGTEFALTISSLQPEDFATYYCLQHNSFPWTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1426 - protein, 7 aa, Artificial Sequence
  Synthetic polypeptide
NVRMGVS

SEQ ID NO: 1427 - protein, 16 aa, Artificial Sequence
  Synthetic polypeptide
HISSNDEKSYSTSLRS

SEQ ID NO: 1428 - protein, 14 aa, Artificial Sequence
  Synthetic polypeptide
MPGDSNTWRGFFDY

SEQ ID NO: 1429 - protein, 11 aa, Artificial Sequence
  Synthetic polypeptide
RTSQSVNNNLA

SEQ ID NO: 1430 - protein, 7 aa, Artificial Sequence
  Synthetic polypeptide
GASTRAT

SEQ ID NO: 1431 - protein, 9 aa, Artificial Sequence
  Synthetic polypeptide
LQHNSYPLT

SEQ ID NO: 1432 - protein, 124 aa, Artificial Sequence
  Synthetic polypeptide
QVTLKESGPTLVKPTETLTLTCTVSGFSLRNVRMGVSWIRQPPGKCLEWLAHISSNDEKSYSTSLRSRLTISTDTSKSQVVLTMTNMDPVDTATYYCARMPGDSNTWRGFFDYWGQGTLVTVSS

SEQ ID NO: 1433 - protein, 107 aa, Artificial Sequence
  Synthetic polypeptide
EIVMTQSPATLSVSPGERATLSCRTSQSVNNNLAWYQQKPGQAPRLLIYGASTRATGIPARFSGSGSGTEFTLTISSLQPEDFATYYCLQHNSYPLTFGCGTKVEIK

SEQ ID NO: 1434 - protein, 246 aa, Artificial Sequence
  Synthetic polypeptide
QVTLKESGPTLVKPTETLTLTCTVSGFSLRNVRMGVSWIRQPPGKCLEWLAHISSNDEKSYSTSLRSRLTISTDTSKSQVVLTMTNMDPVDTATYYCARMPGDSNTWRGFFDYWGQGTLVTVSSGGGGSGGGGSGGGGSEIVMTQSPATLSVSPGERATLSCRTSQSVNNNLAWYQQKPGQAPRLLIYGASTRATGIPARFSGSGSGTEFTLTISSLQPEDFATYYCLQHNSYPLTFGCGTKVEIK

SEQ ID NO: 1435 - protein, 501 aa, Artificial Sequence
  Synthetic polypeptide
QVTLKESGPTLVKPTETLTLTCTVSGFSLRNVRMGVSWIRQPPGKCLEWLAHISSNDEKSYSTSLRSRLTISTDTSKSQVVLTMTNMDPVDTATYYCARMPGDSNTWRGFFDYWGQGTLVTVSSGGGGSGGGGSGGGGSEIVMTQSPATLSVSPGERATLSCRTSQSVNNNLAWYQQKPGQAPRLLIYGASTRATGIPARFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1436 - protein, 7 aa, Artificial Sequence
  Synthetic polypeptide
YARMGVS

SEQ ID NO: 1437 - protein, 16 aa, Artificial Sequence
  Synthetic polypeptide
HIFSNDEKSYSTSLKS

SEQ ID NO: 1438 - protein, 14 aa, Artificial Sequence
  Synthetic polypeptide
MPEYSSGWSGAFDI

SEQ ID NO: 1439 - protein, 11 aa, Artificial Sequence
  Synthetic polypeptide
RASQDIRNDLA

SEQ ID NO: 1440 - protein, 7 aa, Artificial Sequence
  Synthetic polypeptide
AASSLQS

SEQ ID NO: 1441 - protein, 9 aa, Artificial Sequence
  Synthetic polypeptide
LQHNSYPLT

SEQ ID NO: 1442 - protein, 124 aa, Artificial Sequence
  Synthetic polypeptide
QVTLKESGPTLVKPTETLTLTCTFSGFSLRYARMGVSWIRQPPGKCLEWLAHIFSNDEKSYSTSLKSRLTISKDTSKSQVVLTLTNMDPVDTATYFCARMPEYSSGWSGAFDIWGQGTMVTVSS

SEQ ID NO: 1443 - protein, 107 aa, Artificial Sequence
  Synthetic polypeptide
DIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGCGTKLEIK

SEQ ID NO: 1444 - protein, 246 aa, Artificial Sequence
  Synthetic polypeptide
QVTLKESGPTLVKPTETLTLTCTFSGFSLRYARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGCGTKLEIK

SEQ ID NO: 1445 - protein, 501 aa, Artificial Sequence
  Synthetic polypeptide
QVTLKESGPTLVKPTETLTLTCTFSGFSLRYARMGVSWIRQPPGKCLEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1446 - protein, 5 aa, Artificial Sequence
  Synthetic polypeptide
SYGMH

SEQ ID NO: 1447 - protein, 17 aa, Artificial Sequence
  Synthetic polypeptide
VISYDGSNEFYADSVKG

SEQ ID NO: 1448 - protein, 20 aa, Artificial Sequence
  Synthetic polypeptide
GGEITMVRGVIGYYYYGMDV

SEQ ID NO: 1449 - protein, 11 aa, Artificial Sequence
  Synthetic polypeptide
RTSQSISSYLN

SEQ ID NO: 1450 - protein, 7 aa, Artificial Sequence
  Synthetic polypeptide
AASSLQS

SEQ ID NO: 1451 - protein, 9 aa, Artificial Sequence
  Synthetic polypeptide
LQHNSYPLT

SEQ ID NO: 1452 - protein, 129 aa, Artificial Sequence
  Synthetic polypeptide
QVQLVESGGGVVQPGRSLRLSCAASGFTFSSYGMHWVRQAPGKCLEWVAVISYDGSNEFYADSVKGRFTISRDNSKNTLYLQMNSLRAEDTAVYYCARGGEITMVRGVIGYYYYGMDVWGQGTTVTVSS

SEQ ID NO: 1453 - protein, 107 aa, Artificial Sequence
  Synthetic polypeptide
DIQMTQSPSSLSASVGDRVTITCRTSQSISSYLNWYQQKPGKAPKLLIYAASSLQSGVPSRFSGSGSGTEFTLTISSLQPEDFATYYCLQHNSYPLTFGCGTKVDIK

SEQ ID NO: 1454 - protein, 251 aa, Artificial Sequence
  Synthetic polypeptide
QVQLVESGGGVVQPGRSLRLSCAASGFTFSSYGMHWVRQAPGKCLEWVAVISYDGSNEFYADSVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRTSQSISSYLNWYQQKPGKAPKLLIYAASSLQSGVPSRFSGSGSGTEFTLTISSLQPEDFATYYCLQHNSYPLTFGCGTKVDIK

SEQ ID NO: 1455 - protein, 506 aa, Artificial Sequence
  Synthetic polypeptide
QVQLVESGGGVVQPGRSLRLSCAASGFTFSSYGMHWVRQAPGKCLEWVAVISYDGSNEFYADSVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRTSQSISSYLNWYQQKPGKAPKLLIYAASSLQSGVPSRFSGSGSGTEFTLTISSLQPEDFATYYCLQHNSYPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1456 - protein, 5 aa, Artificial Sequence
  Synthetic polypeptide
SYGMH

SEQ ID NO: 1457 - protein, 17 aa, Artificial Sequence
  Synthetic polypeptide
VISYDGSNEFYADSVKG

SEQ ID NO: 1458 - protein, 20 aa, Artificial Sequence
  Synthetic polypeptide
GGEITMVRGVIGYYYYGMDV

SEQ ID NO: 1459 - protein, 11 aa, Artificial Sequence
  Synthetic polypeptide
RASQGVRNNLV

SEQ ID NO: 1460 - protein, 7 aa, Artificial Sequence
  Synthetic polypeptide
GASTRAT

SEQ ID NO: 1461 - protein, 9 aa, Artificial Sequence
  Synthetic polypeptide
LQHNSYPLT

SEQ ID NO: 1462 - protein, 129 aa, Artificial Sequence; identical to SEQ ID NO: 1452
  Synthetic polypeptide

SEQ ID NO: 1463 - protein, 107 aa, Artificial Sequence
  Synthetic polypeptide
EIVMTQSPATLSVSPGERATLSCRASQGVRNNLVWYQQKPGQAPRLLIYGASTRATGIPARFSGSGSGTEFTLTISSLQSEDFATYYCLQHNSYPLTFGCGTKVEIK

SEQ ID NO: 1464 - protein, 251 aa, Artificial Sequence
  Synthetic polypeptide
QVQLVESGGGVVQPGRSLRLSCAASGFTFSSYGMHWVRQAPGKCLEWVAVISYDGSNEFYADSVKGRFTISRDNSKNTLYLQMNSLRAEDTAVYYCARGGEITMVRGVIGYYYYGMDVWGQGTTVTVSSGGGGSGGGGSGGGGSEIVMTQSPATLSVSPGERATLSCRASQGVRNNLVWYQQKPGQAPRLLIYGASTRATGIPARFSGSGSGTEFTLTISSLQSEDFATYYCLQHNSYPLTFGCGTKVEIK

SEQ ID NO: 1465 - protein, 506 aa, Artificial Sequence
  Synthetic polypeptide
QVQLVESGGGVVQPGRSLRLSCAASGFTFSSYGMHWVRQAPGKCLEWVAVISYDGSNEFYADSVKGRFTISRDNSKNTLYLQMNSLRAEDTAVYYCARGGEITMVRGVIGYYYYGMDVWGQGTTVTVSSGGGGSGGGGSGGGGSEIVMTQSPATLSVSPGERATLSCRASQGVRNNLVWYQQKPGQAPRLLIYGASTRATGIPARFSGSGSGTEFTLTISSLQSEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1466 - protein, 5 aa, Artificial Sequence
  Synthetic polypeptide
SYGMH

SEQ ID NO: 1467 - protein, 17 aa, Artificial Sequence
  Synthetic polypeptide
VISYDGSNKYYADSVKG

SEQ ID NO: 1468 - protein, 6 aa, Artificial Sequence
  Synthetic polypeptide
SYGMDV

SEQ ID NO: 1469 - protein, 11 aa, Artificial Sequence
  Synthetic polypeptide
RASQGISSWLA

SEQ ID NO: 1470 - protein, 7 aa, Artificial Sequence
  Synthetic polypeptide
AASSLQS

SEQ ID NO: 1471 - protein, 9 aa, Artificial Sequence
  Synthetic polypeptide
QQANSFPWT

SEQ ID NO: 1472 - protein, 115 aa, Artificial Sequence
  Synthetic polypeptide
QVQLVESGGGVVQPGRSLRLSCAASGFTFSSYGMHWVRQAPGKCLEWVAVISYDGSNKYYADSVKGRFTISRDNSKNTLYLQMNSLRAEDTAVYYCARSYGMDVWGQGTTVTVSS

SEQ ID NO: 1473 - protein, 107 aa, Artificial Sequence
  Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSFPWTFGCGTKLEIK

SEQ ID NO: 1474 - protein, 237 aa, Artificial Sequence
  Synthetic polypeptide
QVQLVESGGGVVQPGRSLRLSCAASGFTFSSYGMHWVRQAPGKCLEWVAVISYDGSNKYYADSVKGRFTISRDNSKNTLYLQMNSLRAEDTAVYYCARSYGMDVWGQGTTVTVSSGGGGSGGGGSGGGGSDIQMTQSPSSVSASVGDRVTITCRASQGISSWLAWYQQKPGKAPKLLIYAASSLQSGVPSRFSGSGSGTDFTLTISSLQPEDFATYYCQQANSFPWTFGCGTKLEIK

SEQ ID NO: 1475 - protein, 492 aa, Artificial Sequence
  Synthetic polypeptide
QVQLVESGGGVVQPGRSLRLSCAASGFTFSSYGMHWVRQAPGKCLEWVAVISYDGSNKYYADSVKGRFTISRDNSKNTLYLQMNSLRAEDTAVYYCARSYGMDVWGQGTTVTVSSGGGGSGGGGSGGGGSDIQMTQSPSSVSASVGDRVTITCRASQGISSWLAWYQQKPGKAPKLLIYAASSLQSGVPSRFSGSGSGTDFTLTISSLQPEDFATYYCQQANSFPWTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1476 - protein, 7 aa, Artificial Sequence
  Synthetic polypeptide
NVRMGVS

SEQ ID NO: 1477 - protein, 16 aa, Artificial Sequence
  Synthetic polypeptide
HIFSNDEKLYTTSLKS

SEQ ID NO: 1478 - protein, 14 aa, Artificial Sequence
  Synthetic polypeptide
IVGYGTGWYGYFDY

SEQ ID NO: 1479 - protein, 11 aa, Artificial Sequence
  Synthetic polypeptide
RASQDIRDDLG

SEQ ID NO: 1480 - protein, 7 aa, Artificial Sequence
  Synthetic polypeptide
ATSIRQS

SEQ ID NO: 1481 - protein, 9 aa, Artificial Sequence
  Synthetic polypeptide
LQHHSFPLT

SEQ ID NO: 1482 - protein, 124 aa, Artificial Sequence
  Synthetic polypeptide
QVTLKESGPVLVKPTETLTLTCTVSGFSLRNVRMGVSWIRQPPGKALEWLAHIFSNDEKLYTTSLKSRLTISKDTSKSQVVLTMTNMDPEDTATYYCARIVGYGTGWYGYFDYWGQGTQVTVSS

SEQ ID NO: 1483 - protein, 107 aa, Artificial Sequence
  Synthetic polypeptide
DIQMTQSPSSLSASIGDRVTITCRASQDIRDDLGWYQREPGKAPKRLIYATSIRQSGVPSRFSGSGSGTEFTLTISGLQPEDFATYFCLQHHSFPLTFGGGTKVDIK

SEQ ID NO: 1484 - protein, 246 aa, Artificial Sequence
  Synthetic polypeptide
QVTLKESGPVLVKPTETLTLTCTVSGFSLRNVRMGVSWIRQPPGKALEWLAHIFSNDEKLYTTSLKSRLTISKDTSKSQVVLTMTNMDPEDTATYYCARIVGYGTGWYGYFDYWGQGTQVTVSSGGGGSGGGGSGGGGSDIQMTQSPSSLSASIGDRVTITCRASQDIRDDLGWYQREPGKAPKRLIYATSIRQSGVPSRFSGSGSGTEFTLTISGLQPEDFATYFCLQHHSFPLTFGGGTKVDIK

SEQ ID NO: 1485 - protein, 501 aa, Artificial Sequence
  Synthetic polypeptide
QVTLKESGPVLVKPTETLTLTCTVSGFSLRNVRMGVSWIRQPPGKALEWLAHIFSNDEKLYTTSLKSRLTISKDTSKSQVVLTMTNMDPEDTATYYCARIVGYGTGWYGYFDYWGQGTQVTVSSGGGGSGGGGSGGGGSDIQMTQSPSSLSASIGDRVTITCRASQDIRDDLGWYQREPGKAPKRLIYATSIRQSGVPSRFSGSGSGTEFTLTISGLQPEDFATYFCLQHHSFPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1486 - protein, 7 aa, Artificial Sequence
  Synthetic polypeptide
YARMGVS

SEQ ID NO: 1487 - protein, 16 aa, Artificial Sequence
  Synthetic polypeptide
HISSNDEKSFSTALES

SEQ ID NO: 1488 - protein, 14 aa, Artificial Sequence
  Synthetic polypeptide
MPGDSNTWRGFFDY

SEQ ID NO: 1489 - protein, 12 aa, Artificial Sequence
  Synthetic polypeptide
RTSQTVTNSYIA

SEQ ID NO: 1490 - protein, 7 aa, Artificial Sequence
  Synthetic polypeptide
GTSTRAT

SEQ ID NO: 1491 - protein, 9 aa, Artificial Sequence
  Synthetic polypeptide
QKYGSSPLT

SEQ ID NO: 1492 - protein, 124 aa, Artificial Sequence
  Synthetic polypeptide
QVTLKESGPTLVKPTETLTLTCTFSGFSLRYARMGVSWIRQPPGKALEWLAHISSNDEKSFSTALESRLTISTDTSKSQMVLTMTNVDPVDTATYYCARMPGDSNTWRGFFDYWGQGTLVTVSS

SEQ ID NO: 1493 - protein, 108 aa, Artificial Sequence
  Synthetic polypeptide
EIVMTQSPGTLSLSPGERATLSCRTSQTVTNSYIAWYQQRPGQAPRLLIYGTSTRATGIPDRFSGSGSGTDFTLTISRLEPEDFAVYYCQKYGSSPLTFGGGTKLEIK

SEQ ID NO: 1494 - protein, 247 aa, Artificial Sequence
  Synthetic polypeptide
QVTLKESGPTLVKPTETLTLTCTFSGFSLRYARMGVSWIRQPPGKALEWLAHISSNDEKSFSTALESRLTISTDTSKSQMVLTMTNVDPVDTATYYCARMPGDSNTWRGFFDYWGQGTLVTVSSGGGGSGGGGSGGGGSEIVMTQSPGTLSLSPGERATLSCRTSQTVTNSYIAWYQQRPGQAPRLLIYGTSTRATGIPDRFSGSGSGTDFTLTISRLEPEDFAVYYCQKYGSSPLTFGGGTKLEIK

SEQ ID NO: 1495 - protein, 502 aa, Artificial Sequence
  Synthetic polypeptide
QVTLKESGPTLVKPTETLTLTCTFSGFSLRYARMGVSWIRQPPGKALEWLAHISSNDEKSFSTALESRLTISTDTSKSQMVLTMTNVDPVDTATYYCARMPGDSNTWRGFFDYWGQGTLVTVSSGGGGSGGGGSGGGGSEIVMTQSPGTLSLSPGERATLSCRTSQTVTNSYIAWYQQRPGQAPRLLIYGTSTRATGIPDRFSGSGSGTDFTLTISRLEPEDFAVYYCQKYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1496 - protein, 7 aa, Artificial Sequence
  Synthetic polypeptide
NVRMGVS

SEQ ID NO: 1497 - protein, 16 aa, Artificial Sequence
  Synthetic polypeptide
HISSNDEKSYSTSLRS

SEQ ID NO: 1498 - protein, 14 aa, Artificial Sequence
  Synthetic polypeptide
MPGDSNTWRGFFDY

SEQ ID NO: 1499 - protein, 11 aa, Artificial Sequence
  Synthetic polypeptide
RTSQSVNNNLA

SEQ ID NO: 1500 - protein, 7 aa, Artificial Sequence
  Synthetic polypeptide
GASTRAT

SEQ ID NO: 1501 - protein, 9 aa, Artificial Sequence
  Synthetic polypeptide
LQHNSYPLT

SEQ ID NO: 1502 - protein, 124 aa, Artificial Sequence
  Synthetic polypeptide
QVTLKESGPTLVKPTETLTLTCTVSGFSLRNVRMGVSWIRQPPGKALEWLAHISSNDEKSYSTSLRSRLTISTDTSKSQVVLTMTNMDPVDTATYYCARMPGDSNTWRGFFDYWGQGTLVTVSS

SEQ ID NO: 1503 - protein, 107 aa, Artificial Sequence
  Synthetic polypeptide
EIVMTQSPATLSVSPGERATLSCRTSQSVNNNLAWYQQKPGQAPRLLIYGASTRATGIPARFSGSGSGTEFTLTISSLQPEDFATYYCLQHNSYPLTFGGGTKVEIK

SEQ ID NO: 1504 - protein, 246 aa, Artificial Sequence
  Synthetic polypeptide
QVTLKESGPTLVKPTETLTLTCTVSGFSLRNVRMGVSWIRQPPGKALEWLAHISSNDEKSYSTSLRSRLTISTDTSKSQVVLTMTNMDPVDTATYYCARMPGDSNTWRGFFDYWGQGTLVTVSSGGGGSGGGGSGGGGSEIVMTQSPATLSVSPGERATLSCRTSQSVNNNLAWYQQKPGQAPRLLIYGASTRATGIPARFSGSGSGTEFTLTISSLQPEDFATYYCLQHNSYPLTFGGGTKVEIK

SEQ ID NO: 1505 - protein, 501 aa, Artificial Sequence
  Synthetic polypeptide
QVTLKESGPTLVKPTETLTLTCTVSGFSLRNVRMGVSWIRQPPGKALEWLAHISSNDEKSYSTSLRSRLTISTDTSKSQVVLTMTNMDPVDTATYYCARMPGDSNTWRGFFDYWGQGTLVTVSSGGGGSGGGGSGGGGSEIVMTQSPATLSVSPGERATLSCRTSQSVNNNLAWYQQKPGQAPRLLIYGASTRATGIPARFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1506 - protein, 7 aa, Artificial Sequence
  Synthetic polypeptide
NVRMGVS

SEQ ID NO: 1507 - protein, 16 aa, Artificial Sequence
  Synthetic polypeptide
HIFSNDEKSYSTSLKS

SEQ ID NO: 1508 - protein, 14 aa, Artificial Sequence
  Synthetic polypeptide
MPEYSSGWSGAFDI

SEQ ID NO: 1509 - protein, 11 aa, Artificial Sequence
  Synthetic polypeptide
RASQDIRDDLG

SEQ ID NO: 1510 - protein, 7 aa, Artificial Sequence
  Synthetic polypeptide
GASTLQS

SEQ ID NO: 1511 - protein, 9 aa, Artificial Sequence
  Synthetic polypeptide
LQHNSYPLT

SEQ ID NO: 1512 - protein, 124 aa, Artificial Sequence
  Synthetic polypeptide
QVTLKESGPMLVKPTETLTLTCTVSGFSLRNVRMGVSWIRQPPGKALEWLAHIFSNDEKSYSTSLKSRLTISKDTSKSQVVLTLTNMDPVDTATYFCARMPEYSSGWSGAFDIWGQGTMVTVSS

SEQ ID NO: 1513 - protein, 107 aa, Artificial Sequence
  Synthetic polypeptide
DIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTRLEIK

SEQ ID NO: 1514 - protein, 246 aa, Artificial Sequence
  Synthetic polypeptide
QVTLKESGPMLVKPTETLTLTCTVSGFSLRNVRMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTRLEIK

SEQ ID NO: 1515 - protein, 501 aa, Artificial Sequence
  Synthetic polypeptide
QVTLKESGPMLVKPTETLTLTCTVSGFSLRNVRMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRDDLGWYQQKPGNAPKRLIYGASTLQSGVPSRFSGSGSGTEFTLTISSLQPEDFATYYCLQHNSYPLTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1516 - protein, 7 aa, Artificial Sequence
  Synthetic polypeptide
NARMGVS

SEQ ID NO: 1517 - protein, 16 aa, Artificial Sequence
  Synthetic polypeptide
HIFSNDEKSYSTSLKS

SEQ ID NO: 1518 - protein, 14 aa, Artificial Sequence
  Synthetic polypeptide
MVGYGSGWYAYFDY

SEQ ID NO: 1519 - protein, 16 aa, Artificial Sequence
  Synthetic polypeptide
RSSQSLLHSNGYNYLY

SEQ ID NO: 1520 - protein, 7 aa, Artificial Sequence
  Synthetic polypeptide
EVSNRFS

SEQ ID NO: 1521 - protein, 9 aa, Artificial Sequence
  Synthetic polypeptide
MQALQTPLT

SEQ ID NO: 1522 - protein, 124 aa, Artificial Sequence
  Synthetic polypeptide
QVTLKESGPALVKPTQTLTLTCTFSGFSLSNARMGVSWIRQPPGKALEWLAHIFSNDEKSYSTSLKSRLTISKDTSKRQVVLTMTNMDPVDTATYYCARMVGYGSGWYAYFDYWGQGTLVTVSS

SEQ ID NO: 1523 - protein, 112 aa, Artificial Sequence
  Synthetic polypeptide
DIVMTQTPLSLSVTPGQPASISCRSSQSLLHSNGYNYLYWYLQKPGQPPQLLIYEVSNRFSGVPDRFSGSGSGTDFTLKISRVEAEDVGVYYCMQALQTPLTFGGGTKVEIK

SEQ ID NO: 1524 - protein, 251 aa, Artificial Sequence
  Synthetic polypeptide
QVTLKESGPALVKPTQTLTLTCTFSGFSLSNARMGVSWIRQPPGKALEWLAHIFSNDEKSYSTSLKSRLTISKDTSKRQVVLTMTNMDPVDTATYYCARMVGYGSGWYAYFDYWGQGTLVTVSSGGGGSGGGGSGGGGSDIVMTQTPLSLSVTPGQPASISCRSSQSLLHSNGYNYLYWYLQKPGQPPQLLIYEVSNRFSGVPDRFSGSGSGTDFTLKISRVEAEDVGVYYCMQALQTPLTFGGGTKVEIK

SEQ ID NO: 1525 - protein, 506 aa, Artificial Sequence
  Synthetic polypeptide
QVTLKESGPALVKPTQTLTLTCTFSGFSLSNARMGVSWIRQPPGKALEWLAHIFSNDEKSYSTSLKSRLTISKDTSKRQVVLTMTNMDPVDTATYYCARMVGYGSGWYAYFDYWGQGTLVTVSSGGGGSGGGGSGGGGSDIVMTQTPLSLSVTPGQPASISCRSSQSLLHSNGYNYLYWYLQKPGQPPQLLIYEVSNRFSGVPDRFSGSGSGTDFTLKISRVEAEDVGVYYCMQALQTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1526 - protein, 5 aa, Artificial Sequence
  Synthetic polypeptide
SYGMH

SEQ ID NO: 1527 - protein, 17 aa, Artificial Sequence
  Synthetic polypeptide
VISYDGSNEFYADSVKG

SEQ ID NO: 1528 - protein, 20 aa, Artificial Sequence
  Synthetic polypeptide
GGEITMVRGVIGYYYYGMDV

SEQ ID NO: 1529 - protein, 11 aa, Artificial Sequence
  Synthetic polypeptide
RASQSISSYLN

SEQ ID NO: 1530 - protein, 7 aa, Artificial Sequence
  Synthetic polypeptide
AASSLQS

SEQ ID NO: 1531 - protein, 9 aa, Artificial Sequence
  Synthetic polypeptide
LQHNSYPLT

SEQ ID NO: 1532 - protein, 129 aa, Artificial Sequence
  Synthetic polypeptide
QVQLVESGGGVVQPGRSLRLSCAASGFTFSSYGMHWVRQAPGKGLEWVAVISYDGSNEFYADSVKGRFTISRDNSKNTLYLQMNSLRAEDTAVYYCARGGEITMVRGVIGYYYYGMDVWGQGTTVTVSS

SEQ ID NO: 1533 - protein, 107 aa, Artificial Sequence
  Synthetic polypeptide
DIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGGGTKVEIK

SEQ ID NO: 1534 - protein, 251 aa, Artificial Sequence
  Synthetic polypeptide
QVQLVESGGGVVQPGRSLRLSCAASGFTFSSYGMHWVRQAPGKGLEWVAVISYDGSNEFYADSVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGGGTKVEIK

SEQ ID NO: 1535 - protein, 506 aa, Artificial Sequence
  Synthetic polypeptide
QVQLVESGGGVVQPGRSLRLSCAASGFTFSSYGMHWVRQAPGKGLEWVAVISYDGSNEFYADSVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTEFTLTISSLQPEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1536 - protein, 5 aa, Artificial Sequence
  Synthetic polypeptide
SYGMH

SEQ ID NO: 1537 - protein, 17 aa, Artificial Sequence
  Synthetic polypeptide
VISYDGSNEFYADSVKG

SEQ ID NO: 1538 - protein, 20 aa, Artificial Sequence
  Synthetic polypeptide
GGEITMVRGVIGYYYYGMDV

SEQ ID NO: 1539 - protein, 11 aa, Artificial Sequence
  Synthetic polypeptide
RASQGVRNNLV

SEQ ID NO: 1540 - protein, 7 aa, Artificial Sequence
  Synthetic polypeptide
GASTRAT

SEQ ID NO: 1541 - protein, 9 aa, Artificial Sequence
  Synthetic polypeptide
LQHNSYPLT

SEQ ID NO: 1542 - protein, 129 aa, Artificial Sequence; identical to SEQ ID NO: 1532
  Synthetic polypeptide

SEQ ID NO: 1543 - protein, 107 aa, Artificial Sequence
  Synthetic polypeptide
EIVMTQSPATLSVSPGERATLSCRASQGVRNNLVWYQQKPGQAPRLLIYGASTRATGIPARFSGSGSGTEFTLTISSLQSEDFATYYCLQHNSYPLTFGGGTKVEIK

SEQ ID NO: 1544 - protein, 251 aa, Artificial Sequence
  Synthetic polypeptide
QVQLVESGGGVVQPGRSLRLSCAASGFTFSSYGMHWVRQAPGKGLEWVAVISYDGSNEFYADSVKGRFTISRDNSKNTLYLQMNSLRAEDTAVYYCARGGEITMVRGVIGYYYYGMDVWGQGTTVTVSSGGGGSGGGGSGGGGSEIVMTQSPATLSVSPGERATLSCRASQGVRNNLVWYQQKPGQAPRLLIYGASTRATGIPARFSGSGSGTEFTLTISSLQSEDFATYYCLQHNSYPLTFGGGTKVEIK

SEQ ID NO: 1545 - protein, 506 aa, Artificial Sequence
  Synthetic polypeptide
QVQLVESGGGVVQPGRSLRLSCAASGFTFSSYGMHWVRQAPGKGLEWVAVISYDGSNEFYADSVKGRFTISRDNSKNTLYLQMNSLRAEDTAVYYCARGGEITMVRGVIGYYYYGMDVWGQGTTVTVSSGGGGSGGGGSGGGGSEIVMTQSPATLSVSPGERATLSCRASQGVRNNLVWYQQKPGQAPRLLIYGASTRATGIPARFSGSGSGTEFTLTISSLQSEDFATYYCLQHNSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1546 - protein, 5 aa, Artificial Sequence
  Synthetic polypeptide
SYGMH

SEQ ID NO: 1547 - protein, 17 aa, Artificial Sequence
  Synthetic polypeptide
VISYDGSNEFYADSVKG

SEQ ID NO: 1548 - protein, 20 aa, Artificial Sequence
  Synthetic polypeptide
GGEITMVRGVIGYYYYGMDV

SEQ ID NO: 1549 - protein, 11 aa, Artificial Sequence
  Synthetic polypeptide
RTSQSISSYLN

SEQ ID NO: 1550 - protein, 7 aa, Artificial Sequence
  Synthetic polypeptide
AASSLQS

SEQ ID NO: 1551 - protein, 9 aa, Artificial Sequence
  Synthetic polypeptide
LQHNSYPLT

SEQ ID NO: 1552 - protein, 129 aa, Artificial Sequence; identical to SEQ ID NO: 1532
  Synthetic polypeptide

SEQ ID NO: 1553 - protein, 107 aa, Artificial Sequence
  Synthetic polypeptide
DIQMTQSPSSLSASVGDRVTITCRTSQSISSYLNWYQQKPGKAPKLLIYAASSLQSGVPSRFSGSGSGTEFTLTISSLQPEDFATYYCLQHNSYPLTFGGGTKVDIK

SEQ ID NO: 1554 - protein, 251 aa, Artificial Sequence
  Synthetic polypeptide
QVQLVESGGGVVQPGRSLRLSCAASGFTFSSYGMHWVRQAPGKGLEWVAVISYDGSNEFYADSVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRTSQSISSYLNWYQQKPGKAPKLLIYAASSLQSGVPSRFSGSGSGTEFTLTISSLQPEDFATYYCLQHNSYPLTFGGGTKVDIK

SEQ ID NO: 1555 - protein, 506 aa, Artificial Sequence
  Synthetic polypeptide
QVQLVESGGGVVQPGRSLRLSCAASGFTFSSYGMHWVRQAPGKGLEWVAVISYDGSNEFYADSVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGDRVTITCRTSQSISSYLNWYQQKPGKAPKLLIYAASSLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1556 - protein, 5 aa, Artificial Sequence
  Synthetic polypeptide
SYGMH

SEQ ID NO: 1557 - protein, 17 aa, Artificial Sequence
  Synthetic polypeptide
VISYDGSNEFYADSVKG

SEQ ID NO: 1558 - protein, 20 aa, Artificial Sequence
  Synthetic polypeptide
GGEITMVRGVIGYYYYGMDV

SEQ ID NO: 1559 - protein, 11 aa, Artificial Sequence
  Synthetic polypeptide
RASQSISSYLN

SEQ ID NO: 1560 - protein, 7 aa, Artificial Sequence
  Synthetic polypeptide
AASSLQS

SEQ ID NO: 1561 - protein, 9 aa, Artificial Sequence
  Synthetic polypeptide
LQHNSYPLT

SEQ ID NO: 1562 - protein, 129 aa, Artificial Sequence; identical to SEQ ID NO: 1532
  Synthetic polypeptide

SEQ ID NO: 1563 - protein, 107 aa, Artificial Sequence
  Synthetic polypeptide
DIQMTQSPSSLSASVGNRVTITCRASQSISSYLNWYQQKPGKAPKLLIYAASSLQSGVPSRFSGSGSGTEFTLTISSLQPEDFATYYCLQHNSYPLTFGGGTKVDIK

SEQ ID NO: 1564 - protein, 251 aa, Artificial Sequence
  Synthetic polypeptide
QVQLVESGGGVVQPGRSLRLSCAASGFTFSSYGMHWVRQAPGKGLEWVAVISYDGSNEFYADSVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGNRVTITCRASQSISSYLNWYQQKPGKAPKLLIYAASSLQSGVPSRFSGSGSGTEFTLTISSLQPEDFATYYCLQHNSYPLTFGGGTKVDIK

SEQ ID NO: 1565 - protein, 506 aa, Artificial Sequence
  Synthetic polypeptide
QVQLVESGGGVVQPGRSLRLSCAASGFTFSSYGMHWVRQAPGKGLEWVAVISYDGSNEFYADSVKGRFTISRDNSKNTLYLQMNSLRAEDTAVYYCARGGEITMVRGVIGYYYYGMDVWGQGTTVTVSSGGGGSGGGGSGGGGSDIQMTQSPSSLSASVGNRVTITCRASQSISSYLNWYQQKPGKAPKLLIYAASSLQSGVPSRFSGSGSGTEFTLTISSLQPEDFATYYCLQHNSYPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1566 - protein, 5 aa, Artificial Sequence
  Synthetic polypeptide
SYGMH

SEQ ID NO: 1567 - protein, 17 aa, Artificial Sequence
  Synthetic polypeptide
VISYDGSNKYYADSVKG

SEQ ID NO: 1568 - protein, 6 aa, Artificial Sequence
  Synthetic polypeptide
SYGMDV

SEQ ID NO: 1569 - protein, 11 aa, Artificial Sequence
  Synthetic polypeptide
RASQGISSWLA

SEQ ID NO: 1570 - protein, 7 aa, Artificial Sequence
  Synthetic polypeptide
AASSLQS

SEQ ID NO: 1571 - protein, 9 aa, Artificial Sequence
  Synthetic polypeptide
QQANSFPWT

SEQ ID NO: 1572 - protein, 115 aa, Artificial Sequence
  Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARSYGMDVWGQGTTVTVSS

SEQ ID NO: 1573 - protein, 107 aa, Artificial Sequence
  Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSFPWTFGQGTKLEIK

SEQ ID NO: 1574 - protein, 237 aa, Artificial Sequence
  Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARSYGMDVWGQGTTVTVSSGGGGSGGGGSGGGGSDIQMTQSPSSVSASVGDRVTITCRASQGISSWLAWYQQKPGKAPKLLIYAASSLQSGVPSRFSGSGSGTDFTLTISSLQPEDFATYYCQQANSFPWTFGQGTKLEIK

SEQ ID NO: 1575 - protein, 492 aa, Artificial Sequence
  Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARSYGMDVWGQGTTVTVSSGGGGSGGGGSGGGGSDIQMTQSPSSVSASVGDRVTITCRASQGISSWLAWYQQKPGKAPKLLIYAASSLQSGVPSRFSGSGSGTDFTLTISSLQPEDFATYYCQQANSFPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1576 - protein, 5 aa, Artificial Sequence
  Synthetic polypeptide
NYGMN

SEQ ID NO: 1577 - protein, 17 aa, Artificial Sequence
  Synthetic polypeptide
WINTYTGEPTYADKFQG

SEQ ID NO: 1578 - protein, 13 aa, Artificial Sequence
  Synthetic polypeptide
WSWSDGYYVYFDY

SEQ ID NO: 1579 - protein, 17 aa, Artificial Sequence
  Synthetic polypeptide
KSSQSVLDSSTNKNSLA

SEQ ID NO: 1580 - protein, 7 aa, Artificial Sequence
  Synthetic polypeptide
WASTRES

SEQ ID NO: 1581 - protein, 9 aa, Artificial Sequence
  Synthetic polypeptide
QQSAHFPIT

SEQ ID NO: 1582 - protein, 122 aa, Artificial Sequence
  Synthetic polypeptide
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSS

SEQ ID NO: 1583 - protein, 113 aa, Artificial Sequence
  Synthetic polypeptide
DIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIK

SEQ ID NO: 1584 - protein, 250 aa, Artificial Sequence
  Synthetic polypeptide
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIK

SEQ ID NO: 1585 - protein, 505 aa, Artificial Sequence
  Synthetic polypeptide
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1586 - protein, 5 aa, Artificial Sequence
  Synthetic polypeptide
NYGMN

SEQ ID NO: 1587 - protein, 17 aa, Artificial Sequence
  Synthetic polypeptide
WINTYTGEPTYADKFQG

SEQ ID NO: 1588 - protein, 13 aa, Artificial Sequence
  Synthetic polypeptide
WSWSDGYYVYFDY

SEQ ID NO: 1589 - protein, 17 aa, Artificial Sequence
  Synthetic polypeptide
KSSQSVLDSSTNKNSLA

SEQ ID NO: 1590 - protein, 7 aa, Artificial Sequence
  Synthetic polypeptide
WASTRES

SEQ ID NO: 1591 - protein, 9 aa, Artificial Sequence
  Synthetic polypeptide
QQSAHFPIT

SEQ ID NO: 1592 - protein, 122 aa, Artificial Sequence
  Synthetic polypeptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSS

SEQ ID NO: 1593 - protein, 113 aa, Artificial Sequence
  Synthetic polypeptide
DIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIK

SEQ ID NO: 1594 - protein, 250 aa, Artificial Sequence
  Synthetic polypeptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIK

SEQ ID NO: 1595 - protein, 505 aa, Artificial Sequence
  Synthetic polypeptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1596 - protein, 5 aa, Artificial Sequence
  Synthetic polypeptide
SYWMN

SEQ ID NO: 1597 - protein, 17 aa, Artificial Sequence
  Synthetic polypeptide
QIWPGDGDTNYNGKFKG

SEQ ID NO: 1598 - protein, 15 aa, Artificial Sequence
  Synthetic polypeptide
RETTTVGRYYYAMDY

SEQ ID NO: 1599 - protein, 15 aa, Artificial Sequence
  Synthetic polypeptide
KASQSVDYDGSSYLN

SEQ ID NO: 1600 - protein, 7 aa, Artificial Sequence
  Synthetic polypeptide
DASNLVS

SEQ ID NO: 1601 - protein, 9 aa, Artificial Sequence
  Synthetic polypeptide
QQSTEDPWT

SEQ ID NO: 1602 - protein, 124 aa, Artificial Sequence
  Synthetic polypeptide
QVQLVQSGAEVKKPGASVKISCKASGYAFTSYWMNWVRQAPGQGLEWIGQIWPGDGDTNYNGKFKGRVTLTADTSTSTAYMELSSLQSEDTAVYYCARRETTTVGRYYYAMDYWGQGTTVTVSS

SEQ ID NO: 1603 - protein, 111 aa, Artificial Sequence
  Synthetic polypeptide
DIQMTQSPSSLSASVGERVTITCKASQSVDYDGSSYLNWYQQKPGKAPKLLIYDASNLVSGVPPRFSGSGSGTDFTLTIHSLQPEDFATYYCQQSTEDPWTFGQGTKVEIK

SEQ ID NO: 1604 - protein, 250 aa, Artificial Sequence
  Synthetic polypeptide
DIQMTQSPSSLSASVGERVTITCKASQSVDYDGSSYLNWYQQKPGKAPKLLIYDASNLVSGVPPRFSGSGSGTDFTLTIHSLQPEDFATYYCQQSTEDPWTFGQGTKVEIKGGGGSGGGGSGGGGSQVQLVQSGAEVKKPGASVKISCKASGYAFTSYWMNWVRQAPGQGLEWIGQIWPGDGDTNYNGKFKGRVTLTADTSTSTAYMELSSLQSEDTAVYYCARRETTTVGRYYYAMDYWGQGTTVTVSS

SEQ ID NO: 1605 - protein, 504 aa, Artificial Sequence
  Synthetic polypeptide
DIQMTQSPSSLSASVGERVTITCKASQSVDYDGSSYLNWYQQKPGKAPKLLIYDASNLVSGVPPRFSGSGSGTDFTLTIHSLQPEDFATYYCQQSTEDPWTFGQGTKVEIKGGGGSGGGGSGGGGSQVQLVQSGAEVKKPGASVKISCKASGYAFTSYWMNWVRQAPGQGLEWIGQIWPGDGDTNYNGKFKGRVTLTADTSTSTAYMELSSLQSEDTAVYYCARRETTTVGRYYYAMDYWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1606 - protein, 5 aa, Artificial Sequence
  Synthetic polypeptide
SYWMN

SEQ ID NO: 1607 - protein, 17 aa, Artificial Sequence
  Synthetic polypeptide
QIWPGDGDTNYNGKFKG

SEQ ID NO: 1608 - protein, 15 aa, Artificial Sequence
  Synthetic polypeptide
RETTTVGRYYYAMDY

SEQ ID NO: 1609 - protein, 15 aa, Artificial Sequence
  Synthetic polypeptide
KASQSVDYDGSSYLN

SEQ ID NO: 1610 - protein, 7 aa, Artificial Sequence
  Synthetic polypeptide
DASNLVS

SEQ ID NO: 1611 - protein, 9 aa, Artificial Sequence
  Synthetic polypeptide
QQSTEDPWT

SEQ ID NO: 1612 - protein, 124 aa, Artificial Sequence
  Synthetic polypeptide
QVQLVQSGAEVVKPGASVKISCKASGYAFTSYWMNWVRQRPGQGLEWIGQIWPGDGDTNYNGKFKGRVTMTADESTSTAYMELSSLRSEDTAVYYCARRETTTVGRYYYAMDYWGQGTTVTVSS

SEQ ID NO: 1613 - protein, 111 aa, Artificial Sequence; identical to SEQ ID NO: 1603
  Synthetic polypeptide

SEQ ID NO: 1614 - protein, 250 aa, Artificial Sequence
  Synthetic polypeptide
DIQMTQSPSSLSASVGERVTITCKASQSVDYDGSSYLNWYQQKPGKAPKLLIYDASNLVSGVPPRFSGSGSGTDFTLTIHSLQPEDFATYYCQQSTEDPWTFGQGTKVEIKGGGGSGGGGSGGGGSQVQLVQSGAEVVKPGASVKISCKASGYAFTSYWMNWVRQRPGQGLEWIGQIWPGDGDTNYNGKFKGRVTMTADESTSTAYMELSSLRSEDTAVYYCARRETTTVGRYYYAMDYWGQGTTVTVSS

SEQ ID NO: 1615 - protein, 504 aa, Artificial Sequence
  Synthetic polypeptide
DIQMTQSPSSLSASVGERVTITCKASQSVDYDGSSYLNWYQQKPGKAPKLLIYDASNLVSGVPPRFSGSGSGTDFTLTIHSLQPEDFATYYCQQSTEDPWTFGQGTKVEIKGGGGSGGGGSGGGGSQVQLVQSGAEVVKPGASVKISCKASGYAFTSYWMNWVRQRPGQGLEWIGQIWPGDGDTNYNGKFKGRVTMTADESTSTAYMELSSLRSEDTAVYYCARRETTTVGRYYYAMDYWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1616 - protein, 5 aa, Artificial Sequence
  Synthetic polypeptide
SYWMN

SEQ ID NO: 1617 - protein, 17 aa, Artificial Sequence
  Synthetic polypeptide
QIWPGDGDTNYNGKFKG

SEQ ID NO: 1618 - protein, 15 aa, Artificial Sequence
  Synthetic polypeptide
RETTTVGRYYYAMDY

SEQ ID NO: 1619 - protein, 15 aa, Artificial Sequence
  Synthetic polypeptide
KASQSVDYDGLSYLN

SEQ ID NO: 1620 - protein, 7 aa, Artificial Sequence
  Synthetic polypeptide
DASNLVS

SEQ ID NO: 1621 - protein, 9 aa, Artificial Sequence
  Synthetic polypeptide
QQSTEDPWT

SEQ ID NO: 1622 - protein, 124 aa, Artificial Sequence; identical to SEQ ID NO: 1612
  Synthetic polypeptide

SEQ ID NO: 1623 - protein, 111 aa, Artificial Sequence
  Synthetic polypeptide
DIQMTQSPSSLSASVGDRVTITCKASQSVDYDGLSYLNWYQQKPGQAPKLLIYDASNLVSGIPSRFSGSGSGTDFTLTISSLEPEDFATYYCQQSTEDPWTFGQGTKVEIK

SEQ ID NO: 1624 - protein, 250 aa, Artificial Sequence
  Synthetic polypeptide
DIQMTQSPSSLSASVGDRVTITCKASQSVDYDGLSYLNWYQQKPGQAPKLLIYDASNLVSGIPSRFSGSGSGTDFTLTISSLEPEDFATYYCQQSTEDPWTFGQGTKVEIKGGGGSGGGGSGGGGSQVQLVQSGAEVVKPGASVKISCKASGYAFTSYWMNWVRQRPGQGLEWIGQIWPGDGDTNYNGKFKGRVTMTADESTSTAYMELSSLRSEDTAVYYCARRETTTVGRYYYAMDYWGQGTTVTVSS

SEQ ID NO: 1625 - protein, 504 aa, Artificial Sequence
  Synthetic polypeptide
DIQMTQSPSSLSASVGDRVTITCKASQSVDYDGLSYLNWYQQKPGQAPKLLIYDASNLVSGIPSRFSGSGSGTDFTLTISSLEPEDFATYYCQQSTEDPWTFGQGTKVEIKGGGGSGGGGSGGGGSQVQLVQSGAEVVKPGASVKISCKASGYAFTSYWMNWVRQRPGQGLEWIGQIWPGDGDTNYNGKFKGRVTMTADESTSTAYMELSSLRSEDTAVYYCARRETTTVGRYYYAMDYWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1626 - protein, 5 aa, Artificial Sequence
  Synthetic polypeptide
SYWMN

SEQ ID NO: 1627 - protein, 17 aa, Artificial Sequence
  Synthetic polypeptide
QIWPGDGDTNYNGKFKG

SEQ ID NO: 1628 - protein, 15 aa, Artificial Sequence
  Synthetic polypeptide
RETTTVGRYYYAMDY

SEQ ID NO: 1629 - protein, 15 aa, Artificial Sequence
  Synthetic polypeptide
KASQSVDYDGTSYLN

SEQ ID NO: 1630 - protein, 7 aa, Artificial Sequence
  Synthetic polypeptide
DASNLVS

SEQ ID NO: 1631 - protein, 9 aa, Artificial Sequence
  Synthetic polypeptide
QQSTEDPWT

SEQ ID NO: 1632 - protein, 124 aa, Artificial Sequence; identical to SEQ ID NO: 1612
  Synthetic polypeptide

SEQ ID NO: 1633 - protein, 111 aa, Artificial Sequence
  Synthetic polypeptide
DIQMTQSPSSLAASVGERVTITCKASQSVDYDGTSYLNWYQQKPGKAPKLLIYDASNLVSGVPSRFSGSGSGTDFTLTINSLEKEDFATYYCQQSTEDPWTFGQGTKVEIK

SEQ ID NO: 1634 - protein, 250 aa, Artificial Sequence
  Synthetic polypeptide
DIQMTQSPSSLAASVGERVTITCKASQSVDYDGTSYLNWYQQKPGKAPKLLIYDASNLVSGVPSRFSGSGSGTDFTLTINSLEKEDFATYYCQQSTEDPWTFGQGTKVEIKGGGGSGGGGSGGGGSQVQLVQSGAEVVKPGASVKISCKASGYAFTSYWMNWVRQRPGQGLEWIGQIWPGDGDTNYNGKFKGRVTMTADESTSTAYMELSSLRSEDTAVYYCARRETTTVGRYYYAMDYWGQGTTVTVSS

SEQ ID NO: 1635 - protein, 504 aa, Artificial Sequence
  Synthetic polypeptide
DIQMTQSPSSLAASVGERVTITCKASQSVDYDGTSYLNWYQQKPGKAPKLLIYDASNLVSGVPSRFSGSGSGTDFTLTINSLEKEDFATYYCQQSTEDPWTFGQGTKVEIKGGGGSGGGGSGGGGSQVQLVQSGAEVVKPGASVKISCKASGYAFTSYWMNWVRQRPGQGLEWIGQIWPGDGDTNYNGKFKGRVTMTADESTSTAYMELSSLRSEDTAVYYCARRETTTVGRYYYAMDYWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1636 - protein, 5 aa, Artificial Sequence
  Synthetic polypeptide
TYAMN

SEQ ID NO: 1637 - protein, 19 aa, Artificial Sequence
  Synthetic polypeptide
RIRSKGNNYATYYADSVKG

SEQ ID NO: 1638 - protein, 17 aa, Artificial Sequence
  Synthetic polypeptide
HIPYASNNEGIYYAMDY

SEQ ID NO: 1639 - protein, 11 aa, Artificial Sequence
  Synthetic polypeptide
RASQDISNYLN

SEQ ID NO: 1640 - protein, 7 aa, Artificial Sequence
  Synthetic polypeptide
YTSRLHS

SEQ ID NO: 1641 - protein, 9 aa, Artificial Sequence
  Synthetic polypeptide
QQGNKLPYT

SEQ ID NO: 1642 - protein, 128 aa, Artificial Sequence
  Synthetic polypeptide
EVQLLESGGGLVQPGGSLRLSCAASGFTFSTYAMNWVRQAPGKGLEWVSRIRSKGNNYATYYADSVKGRFTISRDDSKNTLYLQMNSLRAEDTAVYYCARHIPYASNNEGIYYAMDYWGQGTLVTVSS

SEQ ID NO: 1643 - protein, 107 aa, Artificial Sequence
  Synthetic polypeptide
DIQMTQSPSSLSASVGDRVTITCRASQDISNYLNWYQQKPGKAPKLLIYYTSRLHSGVPSRFSGSGSGTDFTLTISSLQPEDFATYYCQQGNKLPYTFGQGTKLEIK

SEQ ID NO: 1644 - protein, 250 aa, Artificial Sequence
  Synthetic polypeptide
DIQMTQSPSSLSASVGDRVTITCRASQDISNYLNWYQQKPGKAPKLLIYYTSRLHSGVPSRFSGSGSGTDFTLTISSLQPEDFATYYCQQGNKLPYTFGQGTKLEIKGGGGSGGGGSGGGGSEVQLLESGGGLVQPGGSLRLSCAASGFTFSTYAMNWVRQAPGKGLEWVSRIRSKGNNYATYYADSVKGRFTISRDDSKNTLYLQMNSLRAEDTAVYYCARHIPYASNNEGIYYAMDYWGQGTLVTVSS

SEQ ID NO: 1645 - protein, 504 aa, Artificial Sequence
  Synthetic polypeptide
DIQMTQSPSSLSASVGDRVTITCRASQDISNYLNWYQQKPGKAPKLLIYYTSRLHSGVPSRFSGSGSGTDFTLTISSLQPEDFATYYCQQGNKLPYTFGQGTKLEIKGGGGSGGGGSGGGGSEVQLLESGGGLVQPGGSLRLSCAASGFTFSTYAMNWVRQAPGKGLEWVSRIRSKGNNYATYYADSVKGRFTISRDDSKNTLYLQMNSLRAEDTAVYYCARHIPYASNNEGIYYAMDYWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1646 - protein, 5 aa, Artificial Sequence
  Synthetic polypeptide
TYAMN

SEQ ID NO: 1647 - protein, 19 aa, Artificial Sequence
  Synthetic polypeptide
RIRSKGNNYATYYADSVKG

SEQ ID NO: 1648 - protein, 17 aa, Artificial Sequence
  Synthetic polypeptide
HIPYASNNEGIYYAMDY

SEQ ID NO: 1649 - protein, 11 aa, Artificial Sequence
  Synthetic polypeptide
RASQDISNYLN

SEQ ID NO: 1650 - protein, 7 aa, Artificial Sequence
  Synthetic polypeptide
YTSRLHS

SEQ ID NO: 1651 - protein, 9 aa, Artificial Sequence
  Synthetic polypeptide
QQGNVLPYT

SEQ ID NO: 1652 - protein, 128 aa, Artificial Sequence
  Synthetic polypeptide
EVQLLESGGGLVQPGGSLRLSCAASGFTFSTYAMNWVRQAPGKGLEWVARIRSKGNNYATYYADSVKGRFTISRDDSKNTLYLQMNSLRAEDTAVYYCVKHIPYASNNEGIYYAMDYWGQGTLVTVSS

SEQ ID NO: 1653 - protein, 107 aa, Artificial Sequence
  Synthetic polypeptide
DIQMTQSPSSLSASVGDRVTITCRASQDISNYLNWYQQKPGKAPKLLIYYTSRLHSGVPSRFSGSGSGTDFTLTISSLEPEDFATYYCQQGNVLPYTFGQGTKLEIK

SEQ ID NO: 1654 - protein, 250 aa, Artificial Sequence
  Synthetic polypeptide
DIQMTQSPSSLSASVGDRVTITCRASQDISNYLNWYQQKPGKAPKLLIYYTSRLHSGVPSRFSGSGSGTDFTLTISSLEPEDFATYYCQQGNVLPYTFGQGTKLEIKGGGGSGGGGSGGGGSEVQLLESGGGLVQPGGSLRLSCAASGFTFSTYAMNWVRQAPGKGLEWVARIRSKGNNYATYYADSVKGRFTISRDDSKNTLYLQMNSLRAEDTAVYYCVKHIPYASNNEGIYYAMDYWGQGTLVTVSS

SEQ ID NO: 1655 - protein, 504 aa, Artificial Sequence
  Synthetic polypeptide
DIQMTQSPSSLSASVGDRVTITCRASQDISNYLNWYQQKPGKAPKLLIYYTSRLHSGVPSRFSGSGSGTDFTLTISSLEPEDFATYYCQQGNVLPYTFGQGTKLEIKGGGGSGGGGSGGGGSEVQLLESGGGLVQPGGSLRLSCAASGFTFSTYAMNWVRQAPGKGLEWVARIRSKGNNYATYYADSVKGRFTISRDDSKNTLYLQMNSLRAEDTAVYYCVKHIPYASNNEGIYYAMDYWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1656 - protein, 5 aa, Artificial Sequence
  Synthetic polypeptide
TYAMN

SEQ ID NO: 1657 - protein, 19 aa, Artificial Sequence
  Synthetic polypeptide
RIRSKGNNYATYYADSVKG

SEQ ID NO: 1658 - protein, 17 aa, Artificial Sequence
  Synthetic polypeptide
HIPYASNNEGIYYAMDY

SEQ ID NO: 1659 - protein, 11 aa, Artificial Sequence
  Synthetic polypeptide
RASQDISNYLN

SEQ ID NO: 1660 - protein, 7 aa, Artificial Sequence
  Synthetic polypeptide
YTSRLHS

SEQ ID NO: 1661 - protein, 9 aa, Artificial Sequence
  Synthetic polypeptide
QQGNYLPYT

SEQ ID NO: 1662 - protein, 128 aa, Artificial Sequence
  Synthetic polypeptide
EVQLLESGGGLVQPGGSLRLSCAASGFTFSTYAMNWVRQAPGKGLEWVSRIRSKGNNYATYYADSVKGRFTISRDDSKNTLYLQMNSLRAEDTAVYYCVKHIPYASNNEGIYYAMDYWGQGTLVTVSS

SEQ ID NO: 1663 - protein, 107 aa, Artificial Sequence
  Synthetic polypeptide
DIQMTQSPSSLSASVGDRVTITCRASQDISNYLNWYQQKPGKAPKLLIYYTSRLHSGVPSRFSGSGSGTDFTLTISSLQPEDFATYYCQQGNYLPYTFGQGTKLEIK

SEQ ID NO: 1664 - protein, 250 aa, Artificial Sequence
  Synthetic polypeptide
DIQMTQSPSSLSASVGDRVTITCRASQDISNYLNWYQQKPGKAPKLLIYYTSRLHSGVPSRFSGSGSGTDFTLTISSLQPEDFATYYCQQGNYLPYTFGQGTKLEIKGGGGSGGGGSGGGGSEVQLLESGGGLVQPGGSLRLSCAASGFTFSTYAMNWVRQAPGKGLEWVSRIRSKGNNYATYYADSVKGRFTISRDDSKNTLYLQMNSLRAEDTAVYYCVKHIPYASNNEGIYYAMDYWGQGTLVTVSS

SEQ ID NO: 1665 - protein, 504 aa, Artificial Sequence
  Synthetic polypeptide
DIQMTQSPSSLSASVGDRVTITCRASQDISNYLNWYQQKPGKAPKLLIYYTSRLHSGVPSRFSGSGSGTDFTLTISSLQPEDFATYYCQQGNYLPYTFGQGTKLEIKGGGGSGGGGSGGGGSEVQLLESGGGLVQPGGSLRLSCAASGFTFSTYAMNWVRQAPGKGLEWVSRIRSKGNNYATYYADSVKGRFTISRDDSKNTLYLQMNSLRAEDTAVYYCVKHIPYASNNEGIYYAMDYWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1666 - protein, 5 aa, Artificial Sequence
  Synthetic polypeptide
TYAMN

SEQ ID NO: 1667 - protein, 19 aa, Artificial Sequence
  Synthetic polypeptide
RIRSKGNNYATYYADSVKG

SEQ ID NO: 1668 - protein, 17 aa, Artificial Sequence
  Synthetic polypeptide
HIPYASNNEGIYYAMDY

SEQ ID NO: 1669 - protein, 11 aa, Artificial Sequence
  Synthetic polypeptide
RASQDISNYLN

SEQ ID NO: 1670 - protein, 7 aa, Artificial Sequence
  Synthetic polypeptide
YTSRLHS

SEQ ID NO: 1671 - protein, 9 aa, Artificial Sequence
  Synthetic polypeptide
QQGNSLPYT

SEQ ID NO: 1672 - protein, 128 aa, Artificial Sequence
  Synthetic polypeptide
EVQLLESGGGLVQPGGSLRLSCAASGFTFSTYAMNWVRQAPGKGLEWVSRIRSKGNNYATYYADSVKGRFTISRDDSKNTLYLQMNNLRAEDTAVYYCVRHIPYASNNEGIYYAMDYWGQGTLVTVSS

SEQ ID NO: 1673 - protein, 107 aa, Artificial Sequence
  Synthetic polypeptide
DIQMTQSPSSLSASVGDRVTITCRASQDISNYLNWYQQKPGRAPKLLIYYTSRLHSGVPSRFSGSGSGTDFTLTISSLQPEDFATYYCQQGNSLPYTFGQGTKLEIK

SEQ ID NO: 1674 - protein, 250 aa, Artificial Sequence
  Synthetic polypeptide
DIQMTQSPSSLSASVGDRVTITCRASQDISNYLNWYQQKPGRAPKLLIYYTSRLHSGVPSRFSGSGSGTDFTLTISSLQPEDFATYYCQQGNSLPYTFGQGTKLEIKGGGGSGGGGSGGGGSEVQLLESGGGLVQPGGSLRLSCAASGFTFSTYAMNWVRQAPGKGLEWVSRIRSKGNNYATYYADSVKGRFTISRDDSKNTLYLQMNNLRAEDTAVYYCVRHIPYASNNEGIYYAMDYWGQGTLVTVSS

SEQ ID NO: 1675 - protein, 504 aa, Artificial Sequence
  Synthetic polypeptide
DIQMTQSPSSLSASVGDRVTITCRASQDISNYLNWYQQKPGRAPKLLIYYTSRLHSGVPSRFSGSGSGTDFTLTISSLQPEDFATYYCQQGNSLPYTFGQGTKLEIKGGGGSGGGGSGGGGSEVQLLESGGGLVQPGGSLRLSCAASGFTFSTYAMNWVRQAPGKGLEWVSRIRSKGNNYATYYADSVKGRFTISRDDSKNTLYLQMNNLRAEDTAVYYCVRHIPYASNNEGIYYAMDYWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1676 - protein, 5 aa, Artificial Sequence
  Synthetic polypeptide
SYAMG

SEQ ID NO: 1677 - protein, 16 aa, Artificial Sequence
  Synthetic polypeptide
VINTGGSAYYASWAKG

SEQ ID NO: 1678 - protein, 17 aa, Artificial Sequence
  Synthetic polypeptide
GDNYIGTARWNFAYFTW

SEQ ID NO: 1679 - protein, 12 aa, Artificial Sequence
  Synthetic polypeptide
QASQSISSRYLA

SEQ ID NO: 1680 - protein, 7 aa, Artificial Sequence
  Synthetic polypeptide
GASTLAT

SEQ ID NO: 1681 - protein, 13 aa, Artificial Sequence
  Synthetic polypeptide
LYGHYSASDSDYP

SEQ ID NO: 1682 - protein, 125 aa, Artificial Sequence
  Synthetic polypeptide
EVQLVESGGGLVTPGGSLTLSCAASGFTFSSYAMGWVRQAPGKGLEWVGVINTGGSAYYASWAKGRFTISRDDSKNTLYLQMNSLKTEDTAVYYCTTGDNYIGTARWNFAYFTWWGQGTLVTVSS

SEQ ID NO: 1683 - protein, 112 aa, Artificial Sequence
  Synthetic polypeptide
DIQMTQSPSSVSASVGGRVTINCQASQSISSRYLAWYQQKPGKAPKLLIYGASTLATGVPSRFSGSGSGTDFTLTISSLQPEDFATYYCLYGHYSASDSDYPFGQGTKLEIK

SEQ ID NO: 1684 - protein, 252 aa, Artificial Sequence
  Synthetic polypeptide
DIQMTQSPSSVSASVGGRVTINCQASQSISSRYLAWYQQKPGKAPKLLIYGASTLATGVPSRFSGSGSGTDFTLTISSLQPEDFATYYCLYGHYSASDSDYPFGQGTKLEIKGGGGSGGGGSGGGGSEVQLVESGGGLVTPGGSLTLSCAASGFTFSSYAMGWVRQAPGKGLEWVGVINTGGSAYYASWAKGRFTISRDDSKNTLYLQMNSLKTEDTAVYYCTTGDNYIGTARWNFAYFTWWGQGTLVTVSS

SEQ ID NO: 1685 - protein, 506 aa, Artificial Sequence
  Synthetic polypeptide
DIQMTQSPSSVSASVGGRVTINCQASQSISSRYLAWYQQKPGKAPKLLIYGASTLATGVPSRFSGSGSGTDFTLTISSLQPEDFATYYCLYGHYSASDSDYPFGQGTKLEIKGGGGSGGGGSGGGGSEVQLVESGGGLVTPGGSLTLSCAASGFTFSSYAMGWVRQAPGKGLEWVGVINTGGSAYYASWAKGRFTISRDDSKNTLYLQMNSLKTEDTAVYYCTTGDNYIGTARWNFAYFTWWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1686 - protein, 5 aa, Artificial Sequence
  Synthetic polypeptide
SYAMG

SEQ ID NO: 1687 - protein, 16 aa, Artificial Sequence
  Synthetic polypeptide
IINTGGSAYYASWAKG

SEQ ID NO: 1688 - protein, 17 aa, Artificial Sequence
  Synthetic polypeptide
GDNYIGTARWNFAYFTY

SEQ ID NO: 1689 - protein, 12 aa, Artificial Sequence
  Synthetic polypeptide
QASQSISSRYLA

SEQ ID NO: 1690 - protein, 7 aa, Artificial Sequence
  Synthetic polypeptide
GASTLAT

SEQ ID NO: 1691 - protein, 13 aa, Artificial Sequence
  Synthetic polypeptide
LYGHYSASDSDYP

SEQ ID NO: 1692 - protein, 125 aa, Artificial Sequence
  Synthetic polypeptide
EVQLVESEGGLVKPGGSLRLSCAASGFTFSSYAMGWVRQAPGKGLEWVGIINTGGSAYYASWAKGRFTISRDDSKNTLYLQMNSLKTEDTAVYYCVTGDNYIGTARWNFAYFTYWGQGTLVTVSS

SEQ ID NO: 1693 - protein, 112 aa, Artificial Sequence; identical to SEQ ID NO: 1683
  Synthetic polypeptide

SEQ ID NO: 1694 - protein, 252 aa, Artificial Sequence
  Synthetic polypeptide
DIQMTQSPSSVSASVGGRVTINCQASQSISSRYLAWYQQKPGKAPKLLIYGASTLATGVPSRFSGSGSGTDFTLTISSLQPEDFATYYCLYGHYSASDSDYPFGQGTKLEIKGGGGSGGGGSGGGGSEVQLVESEGGLVKPGGSLRLSCAASGFTFSSYAMGWVRQAPGKGLEWVGIINTGGSAYYASWAKGRFTISRDDSKNTLYLQMNSLKTEDTAVYYCVTGDNYIGTARWNFAYFTYWGQGTLVTVSS

SEQ ID NO: 1695 - protein, 506 aa, Artificial Sequence
  Synthetic polypeptide
DIQMTQSPSSVSASVGGRVTINCQASQSISSRYLAWYQQKPGKAPKLLIYGASTLATGVPSRFSGSGSGTDFTLTISSLQPEDFATYYCLYGHYSASDSDYPFGQGTKLEIKGGGGSGGGGSGGGGSEVQLVESEGGLVKPGGSLRLSCAASGFTFSSYAMGWVRQAPGKGLEWVGIINTGGSAYYASWAKGRFTISRDDSKNTLYLQMNSLKTEDTAVYYCVTGDNYIGTARWNFAYFTYWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1696 - protein, 5 aa, Artificial Sequence
  Synthetic polypeptide
SYAMG

SEQ ID NO: 1697 - protein, 16 aa, Artificial Sequence
  Synthetic polypeptide
VINTGGSAYYASWAKG

SEQ ID NO: 1698 - protein, 17 aa, Artificial Sequence
  Synthetic polypeptide
GDNYIGTARWNFAYFTY

SEQ ID NO: 1699 - protein, 12 aa, Artificial Sequence
  Synthetic polypeptide
QASQSISSRYLA

SEQ ID NO: 1700 - protein, 7 aa, Artificial Sequence
  Synthetic polypeptide
GASTLAA

SEQ ID NO: 1701 - protein, 13 aa, Artificial Sequence
  Synthetic polypeptide
LYGHYSASDSDYP

SEQ ID NO: 1702 - protein, 125 aa, Artificial Sequence
  Synthetic polypeptide
EVQLVESGGGLVTPGGSLTLSCAASGFTFSSYAMGWVRQAPGKGLEWVGVINTGGSAYYASWAKGRFTISRDDSKNTLYLQMNSLKTEDTAVYYCITGDNYIGTARWNFAYFTYWSQGTLVTVSS

SEQ ID NO: 1703 - protein, 112 aa, Artificial Sequence
  Synthetic polypeptide
DIQMTQSPSSVSASVGDRVTINCQASQSISSRYLAWYQQKPGKAPKLLIYGASTLAAGVPSKFSGSGSGTDFTLTISSLQPEDFATYYCLYGHYSASDSDYPFGQGTKLEIK

SEQ ID NO: 1704 - protein, 252 aa, Artificial Sequence
  Synthetic polypeptide
DIQMTQSPSSVSASVGDRVTINCQASQSISSRYLAWYQQKPGKAPKLLIYGASTLAAGVPSKFSGSGSGTDFTLTISSLQPEDFATYYCLYGHYSASDSDYPFGQGTKLEIKGGGGSGGGGSGGGGSEVQLVESGGGLVTPGGSLTLSCAASGFTFSSYAMGWVRQAPGKGLEWVGVINTGGSAYYASWAKGRFTISRDDSKNTLYLQMNSLKTEDTAVYYCITGDNYIGTARWNFAYFTYWSQGTLVTVSS

SEQ ID NO: 1705 - protein, 506 aa, Artificial Sequence
  Synthetic polypeptide
DIQMTQSPSSVSASVGDRVTINCQASQSISSRYLAWYQQKPGKAPKLLIYGASTLAAGVPSKFSGSGSGTDFTLTISSLQPEDFATYYCLYGHYSASDSDYPFGQGTKLEIKGGGGSGGGGSGGGGSEVQLVESGGGLVTPGGSLTLSCAASGFTFSSYAMGWVRQAPGKGLEWVGVINTGGSAYYASWAKGRFTISRDDSKNTLYLQMNSLKTEDTAVYYCITGDNYIGTARWNFAYFTYWSQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1706 - protein, 5 aa, Artificial Sequence
  Synthetic polypeptide
SYAMG

SEQ ID NO: 1707 - protein, 16 aa, Artificial Sequence
  Synthetic polypeptide
VINTGGSAYYASWAKG

SEQ ID NO: 1708 - protein, 17 aa, Artificial Sequence
  Synthetic polypeptide
GDNYIGTARWNFAYFTW

SEQ ID NO: 1709 - protein, 12 aa, Artificial Sequence
  Synthetic polypeptide
QASQSISSRYLA

SEQ ID NO: 1710 - protein, 7 aa, Artificial Sequence
  Synthetic polypeptide
GASTLAM

SEQ ID NO: 1711 - protein, 13 aa, Artificial Sequence
  Synthetic polypeptide
LYGHYSASDSDYP

SEQ ID NO: 1712 - protein, 125 aa, Artificial Sequence; identical to SEQ ID NO: 1682
  Synthetic polypeptide

SEQ ID NO: 1713 - protein, 112 aa, Artificial Sequence
  Synthetic polypeptide
DIQMTQSPSSVSASVGDRVTINCQASQSISSRYLAWYQQKPGQAPKLLIYGASTLAMGVPSRFSGSGSGTDFTLTISSLQPEDFATYYCLYGHYSASDSDYPFGQGTKLEIK

SEQ ID NO: 1714 - protein, 252 aa, Artificial Sequence
  Synthetic polypeptide
DIQMTQSPSSVSASVGDRVTINCQASQSISSRYLAWYQQKPGQAPKLLIYGASTLAMGVPSRFSGSGSGTDFTLTISSLQPEDFATYYCLYGHYSASDSDYPFGQGTKLEIKGGGGSGGGGSGGGGSEVQLVESGGGLVTPGGSLTLSCAASGFTFSSYAMGWVRQAPGKGLEWVGVINTGGSAYYASWAKGRFTISRDDSKNTLYLQMNSLKTEDTAVYYCTTGDNYIGTARWNFAYFTWWGQGTLVTVSS

SEQ ID NO: 1715 - protein, 506 aa, Artificial Sequence
  Synthetic polypeptide
DIQMTQSPSSVSASVGDRVTINCQASQSISSRYLAWYQQKPGQAPKLLIYGASTLAMGVPSRFSGSGSGTDFTLTISSLQPEDFATYYCLYGHYSASDSDYPFGQGTKLEIKGGGGSGGGGSGGGGSEVQLVESGGGLVTPGGSLTLSCAASGFTFSSYAMGWVRQAPGKGLEWVGVINTGGSAYYASWAKGRFTISRDDSKNTLYLQMNSLKTEDTAVYYCTTGDNYIGTARWNFAYFTWWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1716 - protein, 5 aa, Artificial Sequence
  Synthetic polypeptide
SYGVS

SEQ ID NO: 1717 - protein, 17 aa, Artificial Sequence
  Synthetic polypeptide
YNDPVFGSIYYASWVKG

SEQ ID NO: 1718 - protein, 14 aa, Artificial Sequence
  Synthetic polypeptide
DRSYVSSSGYHFNL

SEQ ID NO: 1719 - protein, 11 aa, Artificial Sequence
  Synthetic polypeptide
QASETIYSSLA

SEQ ID NO: 1720 - protein, 7 aa, Artificial Sequence
  Synthetic polypeptide
GASNLES

SEQ ID NO: 1721 - protein, 10 aa, Artificial Sequence
  Synthetic polypeptide
QSGVYSAGLT

SEQ ID NO: 1722 - protein, 123 aa, Artificial Sequence
  Synthetic polypeptide
EVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSS

SEQ ID NO: 1723 - protein, 108 aa, Artificial Sequence
  Synthetic polypeptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIK

SEQ ID NO: 1724 - protein, 246 aa, Artificial Sequence
  Synthetic polypeptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSS

SEQ ID NO: 1725 - protein, 500 aa, Artificial Sequence
  Synthetic polypeptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1726 - protein, 5 aa, Artificial Sequence
  Synthetic polypeptide
SYGVS

SEQ ID NO: 1727 - protein, 17 aa, Artificial Sequence
  Synthetic polypeptide
YNDPVFGSIYYASWVKG

SEQ ID NO: 1728 - protein, 14 aa, Artificial Sequence
  Synthetic polypeptide
DRSYVSSSGYHFNL

SEQ ID NO: 1729 - protein, 11 aa, Artificial Sequence
  Synthetic polypeptide
QASETIYSSLA

SEQ ID NO: 1730 - protein, 7 aa, Artificial Sequence
  Synthetic polypeptide
GASNLES

SEQ ID NO: 1731 - protein, 10 aa, Artificial Sequence
  Synthetic polypeptide
QSGVYSAGLT

SEQ ID NO: 1732 - protein, 123 aa, Artificial Sequence; identical to SEQ ID NO: 1722
  Synthetic polypeptide

SEQ ID NO: 1733 - protein, 108 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIK

SEQ ID NO: 1734 - protein, 246 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSS

SEQ ID NO: 1735 - protein, 500 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1736 - protein, 5 aa, Artificial Sequence
  Synthetic polypeptide
SYGVS

SEQ ID NO: 1737 - protein, 17 aa, Artificial Sequence
  Synthetic polypeptide
YNDPVFGSIYYASWVKG

SEQ ID NO: 1738 - protein, 14 aa, Artificial Sequence
  Synthetic polypeptide
DRSYVSSSGYHFNL

SEQ ID NO: 1739 - protein, 11 aa, Artificial Sequence
  Synthetic polypeptide
QASETIYSSLA

SEQ ID NO: 1740 - protein, 7 aa, Artificial Sequence
  Synthetic polypeptide
GASNLES

SEQ ID NO: 1741 - protein, 10 aa, Artificial Sequence
  Synthetic polypeptide
QSGVYSAGLT

SEQ ID NO: 1742 - protein, 123 aa, Artificial Sequence; identical to SEQ ID NO: 1722
  Synthetic polypeptide

SEQ ID NO: 1743 - protein, 108 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGGGTKVEIK

SEQ ID NO: 1744 - protein, 246 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSS

SEQ ID NO: 1745 - protein, 500 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1746 - protein, 5 aa, Artificial Sequence
  Synthetic polypeptide
SYGVS

SEQ ID NO: 1747 - protein, 17 aa, Artificial Sequence
  Synthetic polypeptide
YNDPVFGSIYYASWVKG

SEQ ID NO: 1748 - protein, 14 aa, Artificial Sequence
  Synthetic polypeptide
DRSYVSSSGYHFNL

SEQ ID NO: 1749 - protein, 11 aa, Artificial Sequence
  Synthetic polypeptide
QASETIYSSLA

SEQ ID NO: 1750 - protein, 7 aa, Artificial Sequence
  Synthetic polypeptide
GASNLES

SEQ ID NO: 1751 - protein, 10 aa, Artificial Sequence
  Synthetic polypeptide
QSGVYSAGLT

SEQ ID NO: 1752 - protein, 123 aa, Artificial Sequence
  Synthetic polypeptide
EVQLLESGGGLVQPGGSLRLSCAASGFTFSSYGVSWVRQAPGKGLEWVGYNDPVFGSIYYASWVKGRFTISSDNSKNTLYLQMNSLRAEDTAVYYCAKDRSYVSSSGYHFNLWGQGTLVTVSS

SEQ ID NO: 1753 - protein, 108 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGGGTKVEIK

SEQ ID NO: 1754 - protein, 246 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWVGYNDPVFGSIYYASWVKGRFTISSDNSKNTLYLQMNSLRAEDTAVYYCAKDRSYVSSSGYHFNLWGQGTLVTVSS

SEQ ID NO: 1755 - protein, 500 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWVGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1756 - protein, 5 aa, Artificial Sequence
  Synthetic polypeptide
SYAMG

SEQ ID NO: 1757 - protein, 16 aa, Artificial Sequence
  Synthetic polypeptide
VINTGGSAYYASWAKG

SEQ ID NO: 1758 - protein, 17 aa, Artificial Sequence
  Synthetic polypeptide
GDNYIGTARWNFAYFTW

SEQ ID NO: 1759 - protein, 12 aa, Artificial Sequence
  Synthetic polypeptide
QASQSISSRYLA

SEQ ID NO: 1760 - protein, 7 aa, Artificial Sequence
  Synthetic polypeptide
GASTLAT

SEQ ID NO: 1761 - protein, 13 aa, Artificial Sequence
  Synthetic polypeptide
LYGHYSASDSDYP

SEQ ID NO: 1762 - protein, 125 aa, Artificial Sequence
  Synthetic polypeptide
EVQLVESGGGLVTPGGSLTLSCAASGFTFSSYAMGWVRQAPGKCLEWVGVINTGGSAYYASWAKGRFTISRDDSKNTLYLQMNSLKTEDTAVYYCTTGDNYIGTARWNFAYFTWWGQGTLVTVSS

SEQ ID NO: 1763 - protein, 112 aa, Artificial Sequence
  Synthetic polypeptide
DIQMTQSPSSVSASVGGRVTINCQASQSISSRYLAWYQQKPGKAPKLLIYGASTLATGVPSRFSGSGSGTDFTLTISSLQPEDFATYYCLYGHYSASDSDYPFGCGTKLEIK

SEQ ID NO: 1764 - protein, 252 aa, Artificial Sequence
  Synthetic polypeptide
DIQMTQSPSSVSASVGGRVTINCQASQSISSRYLAWYQQKPGKAPKLLIYGASTLATGVPSRFSGSGSGTDFTLTISSLQPEDFATYYCLYGHYSASDSDYPFGCGTKLEIKGGGGSGGGGSGGGGSEVQLVESGGGLVTPGGSLTLSCAASGFTFSSYAMGWVRQAPGKCLEWVGVINTGGSAYYASWAKGRFTISRDDSKNTLYLQMNSLKTEDTAVYYCTTGDNYIGTARWNFAYFTWWGQGTLVTVSS

SEQ ID NO: 1765 - protein, 506 aa, Artificial Sequence
  Synthetic polypeptide
DIQMTQSPSSVSASVGGRVTINCQASQSISSRYLAWYQQKPGKAPKLLIYGASTLATGVPSRFSGSGSGTDFTLTISSLQPEDFATYYCLYGHYSASDSDYPFGCGTKLEIKGGGGSGGGGSGGGGSEVQLVESGGGLVTPGGSLTLSCAASGFTFSSYAMGWVRQAPGKCLEWVGVINTGGSAYYASWAKGRFTISRDDSKNTLYLQMNSLKTEDTAVYYCTTGDNYIGTARWNFAYFTWWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1766 - protein, 5 aa, Artificial Sequence
  Synthetic polypeptide
SYAMG

SEQ ID NO: 1767 - protein, 16 aa, Artificial Sequence
  Synthetic polypeptide
IINTGGSAYYASWAKG

SEQ ID NO: 1768 - protein, 17 aa, Artificial Sequence
  Synthetic polypeptide
GDNYIGTARWNFAYFTY

SEQ ID NO: 1769 - protein, 12 aa, Artificial Sequence
  Synthetic polypeptide
QASQSISSRYLA

SEQ ID NO: 1770 - protein, 7 aa, Artificial Sequence
  Synthetic polypeptide
GASTLAT

SEQ ID NO: 1771 - protein, 13 aa, Artificial Sequence
  Synthetic polypeptide
LYGHYSASDSDYP

SEQ ID NO: 1772 - protein, 125 aa, Artificial Sequence
  Synthetic polypeptide
EVQLVESEGGLVKPGGSLRLSCAASGFTFSSYAMGWVRQAPGKCLEWVGIINTGGSAYYASWAKGRFTISRDDSKNTLYLQMNSLKTEDTAVYYCVTGDNYIGTARWNFAYFTYWGQGTLVTVSS

SEQ ID NO: 1773 - protein, 112 aa, Artificial Sequence; identical to SEQ ID NO: 1763
  Synthetic polypeptide

SEQ ID NO: 1774 - protein, 252 aa, Artificial Sequence
  Synthetic polypeptide
DIQMTQSPSSVSASVGGRVTINCQASQSISSRYLAWYQQKPGKAPKLLIYGASTLATGVPSRFSGSGSGTDFTLTISSLQPEDFATYYCLYGHYSASDSDYPFGCGTKLEIKGGGGSGGGGSGGGGSEVQLVESEGGLVKPGGSLRLSCAASGFTFSSYAMGWVRQAPGKCLEWVGIINTGGSAYYASWAKGRFTISRDDSKNTLYLQMNSLKTEDTAVYYCVTGDNYIGTARWNFAYFTYWGQGTLVTVSS

SEQ ID NO: 1775 - protein, 506 aa, Artificial Sequence
  Synthetic polypeptide
DIQMTQSPSSVSASVGGRVTINCQASQSISSRYLAWYQQKPGKAPKLLIYGASTLATGVPSRFSGSGSGTDFTLTISSLQPEDFATYYCLYGHYSASDSDYPFGCGTKLEIKGGGGSGGGGSGGGGSEVQLVESEGGLVKPGGSLRLSCAASGFTFSSYAMGWVRQAPGKCLEWVGIINTGGSAYYASWAKGRFTISRDDSKNTLYLQMNSLKTEDTAVYYCVTGDNYIGTARWNFAYFTYWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1776 - protein, 5 aa, Artificial Sequence
  Synthetic polypeptide
SYAMG

SEQ ID NO: 1777 - protein, 16 aa, Artificial Sequence
  Synthetic polypeptide
VINTGGSAYYASWAKG

SEQ ID NO: 1778 - protein, 17 aa, Artificial Sequence
  Synthetic polypeptide
GDNYIGTARWNFAYFTY

SEQ ID NO: 1779 - protein, 12 aa, Artificial Sequence
  Synthetic polypeptide
QASQSISSRYLA

SEQ ID NO: 1780 - protein, 7 aa, Artificial Sequence
  Synthetic polypeptide
GASTLAA

SEQ ID NO: 1781 - protein, 13 aa, Artificial Sequence
  Synthetic polypeptide
LYGHYSASDSDYP

SEQ ID NO: 1782 - protein, 125 aa, Artificial Sequence
  Synthetic polypeptide
EVQLVESGGGLVTPGGSLTLSCAASGFTFSSYAMGWVRQAPGKCLEWVGVINTGGSAYYASWAKGRFTISRDDSKNTLYLQMNSLKTEDTAVYYCITGDNYIGTARWNFAYFTYWSQGTLVTVSS

SEQ ID NO: 1783 - protein, 112 aa, Artificial Sequence
  Synthetic polypeptide
DIQMTQSPSSVSASVGDRVTINCQASQSISSRYLAWYQQKPGKAPKLLIYGASTLAAGVPSKFSGSGSGTDFTLTISSLQPEDFATYYCLYGHYSASDSDYPFGCGTKLEIK

SEQ ID NO: 1784 - protein, 252 aa, Artificial Sequence
  Synthetic polypeptide
DIQMTQSPSSVSASVGDRVTINCQASQSISSRYLAWYQQKPGKAPKLLIYGASTLAAGVPSKFSGSGSGTDFTLTISSLQPEDFATYYCLYGHYSASDSDYPFGCGTKLEIKGGGGSGGGGSGGGGSEVQLVESGGGLVTPGGSLTLSCAASGFTFSSYAMGWVRQAPGKCLEWVGVINTGGSAYYASWAKGRFTISRDDSKNTLYLQMNSLKTEDTAVYYCITGDNYIGTARWNFAYFTYWSQGTLVTVSS

SEQ ID NO: 1785 - protein, 506 aa, Artificial Sequence
  Synthetic polypeptide
DIQMTQSPSSVSASVGDRVTINCQASQSISSRYLAWYQQKPGKAPKLLIYGASTLAAGVPSKFSGSGSGTDFTLTISSLQPEDFATYYCLYGHYSASDSDYPFGCGTKLEIKGGGGSGGGGSGGGGSEVQLVESGGGLVTPGGSLTLSCAASGFTFSSYAMGWVRQAPGKCLEWVGVINTGGSAYYASWAKGRFTISRDDSKNTLYLQMNSLKTEDTAVYYCITGDNYIGTARWNFAYFTYWSQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1786 - protein, 5 aa, Artificial Sequence
  Synthetic polypeptide
SYAMG

SEQ ID NO: 1787 - protein, 16 aa, Artificial Sequence
  Synthetic polypeptide
VINTGGSAYYASWAKG

SEQ ID NO: 1788 - protein, 17 aa, Artificial Sequence
  Synthetic polypeptide
GDNYIGTARWNFAYFTW

SEQ ID NO: 1789 - protein, 12 aa, Artificial Sequence
  Synthetic polypeptide
QASQSISSRYLA

SEQ ID NO: 1790 - protein, 7 aa, Artificial Sequence
  Synthetic polypeptide
GASTLAM

SEQ ID NO: 1791 - protein, 13 aa, Artificial Sequence
  Synthetic polypeptide
LYGHYSASDSDYP

SEQ ID NO: 1792 - protein, 125 aa, Artificial Sequence; identical to SEQ ID NO: 1762
  Synthetic polypeptide

SEQ ID NO: 1793 - protein, 112 aa, Artificial Sequence
  Synthetic polypeptide
DIQMTQSPSSVSASVGDRVTINCQASQSISSRYLAWYQQKPGQAPKLLIYGASTLAMGVPSRFSGSGSGTDFTLTISSLQPEDFATYYCLYGHYSASDSDYPFGCGTKLEIK

SEQ ID NO: 1794 - protein, 252 aa, Artificial Sequence
  Synthetic polypeptide
DIQMTQSPSSVSASVGDRVTINCQASQSISSRYLAWYQQKPGQAPKLLIYGASTLAMGVPSRFSGSGSGTDFTLTISSLQPEDFATYYCLYGHYSASDSDYPFGCGTKLEIKGGGGSGGGGSGGGGSEVQLVESGGGLVTPGGSLTLSCAASGFTFSSYAMGWVRQAPGKCLEWVGVINTGGSAYYASWAKGRFTISRDDSKNTLYLQMNSLKTEDTAVYYCTTGDNYIGTARWNFAYFTWWGQGTLVTVSS

SEQ ID NO: 1795 - protein, 506 aa, Artificial Sequence
  Synthetic polypeptide
DIQMTQSPSSVSASVGDRVTINCQASQSISSRYLAWYQQKPGQAPKLLIYGASTLAMGVPSRFSGSGSGTDFTLTISSLQPEDFATYYCLYGHYSASDSDYPFGCGTKLEIKGGGGSGGGGSGGGGSEVQLVESGGGLVTPGGSLTLSCAASGFTFSSYAMGWVRQAPGKCLEWVGVINTGGSAYYASWAKGRFTISRDDSKNTLYLQMNSLKTEDTAVYYCTTGDNYIGTARWNFAYFTWWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1796 - protein, 5 aa, Artificial Sequence
  Synthetic polypeptide
SYGVS

SEQ ID NO: 1797 - protein, 17 aa, Artificial Sequence
  Synthetic polypeptide
YNDPVFGSIYYASWVKG

SEQ ID NO: 1798 - protein, 14 aa, Artificial Sequence
  Synthetic polypeptide
DRSYVSSSGYHFNL

SEQ ID NO: 1799 - protein, 11 aa, Artificial Sequence
  Synthetic polypeptide
QASETIYSSLA

SEQ ID NO: 1800 - protein, 7 aa, Artificial Sequence
  Synthetic polypeptide
GASNLES

SEQ ID NO: 1801 - protein, 10 aa, Artificial Sequence
  Synthetic polypeptide
QSGVYSAGLT

SEQ ID NO: 1802 - protein, 123 aa, Artificial Sequence
  Synthetic polypeptide
EVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSS

SEQ ID NO: 1803 - protein, 108 aa, Artificial Sequence
  Synthetic polypeptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIK

SEQ ID NO: 1804 - protein, 246 aa, Artificial Sequence
  Synthetic polypeptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSS

SEQ ID NO: 1805 - protein, 500 aa, Artificial Sequence
  Synthetic polypeptide
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1806 - protein, 5 aa, Artificial Sequence
  Synthetic polypeptide
SYGVS

SEQ ID NO: 1807 - protein, 17 aa, Artificial Sequence
  Synthetic polypeptide
YNDPVFGSIYYASWVKG

SEQ ID NO: 1808 - protein, 14 aa, Artificial Sequence
  Synthetic polypeptide
DRSYVSSSGYHFNL

SEQ ID NO: 1809 - protein, 11 aa, Artificial Sequence
  Synthetic polypeptide
QASETIYSSLA

SEQ ID NO: 1810 - protein, 7 aa, Artificial Sequence
  Synthetic polypeptide
GASNLES

SEQ ID NO: 1811 - protein, 10 aa, Artificial Sequence
  Synthetic polypeptide
QSGVYSAGLT

SEQ ID NO: 1812 - protein, 123 aa, Artificial Sequence; identical to SEQ ID NO: 1802
  Synthetic polypeptide

SEQ ID NO: 1813 - protein, 108 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGCGTKVEIK

SEQ ID NO: 1814 - protein, 246 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSS

SEQ ID NO: 1815 - protein, 500 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISSMQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1816 - protein, 5 aa, Artificial Sequence
  Synthetic polypeptide
SYGVS

SEQ ID NO: 1817 - protein, 17 aa, Artificial Sequence
  Synthetic polypeptide
YNDPVFGSIYYASWVKG

SEQ ID NO: 1818 - protein, 14 aa, Artificial Sequence
  Synthetic polypeptide
DRSYVSSSGYHFNL

SEQ ID NO: 1819 - protein, 11 aa, Artificial Sequence
  Synthetic polypeptide
QASETIYSSLA

SEQ ID NO: 1820 - protein, 7 aa, Artificial Sequence
  Synthetic polypeptide
GASNLES

SEQ ID NO: 1821 - protein, 10 aa, Artificial Sequence
  Synthetic polypeptide
QSGVYSAGLT

SEQ ID NO: 1822 - protein, 123 aa, Artificial Sequence; identical to SEQ ID NO: 1802
  Synthetic polypeptide

SEQ ID NO: 1823 - protein, 108 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGCGTKVEIK

SEQ ID NO: 1824 - protein, 246 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSS

SEQ ID NO: 1825 - protein, 500 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISGLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1826 - protein, 5 aa, Artificial Sequence
  Synthetic polypeptide
SYGVS

SEQ ID NO: 1827 - protein, 17 aa, Artificial Sequence
  Synthetic polypeptide
YNDPVFGSIYYASWVKG

SEQ ID NO: 1828 - protein, 14 aa, Artificial Sequence
  Synthetic polypeptide
DRSYVSSSGYHFNL

SEQ ID NO: 1829 - protein, 11 aa, Artificial Sequence
  Synthetic polypeptide
QASETIYSSLA

SEQ ID NO: 1830 - protein, 7 aa, Artificial Sequence
  Synthetic polypeptide
GASNLES

SEQ ID NO: 1831 - protein, 10 aa, Artificial Sequence
  Synthetic polypeptide
QSGVYSAGLT

SEQ ID NO: 1832 - protein, 123 aa, Artificial Sequence
  Synthetic polypeptide
EVQLLESGGGLVQPGGSLRLSCAASGFTFSSYGVSWVRQAPGKCLEWVGYNDPVFGSIYYASWVKGRFTISSDNSKNTLYLQMNSLRAEDTAVYYCAKDRSYVSSSGYHFNLWGQGTLVTVSS

SEQ ID NO: 1833 - protein, 108 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGCGTKVEIK

SEQ ID NO: 1834 - protein, 246 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWVGYNDPVFGSIYYASWVKGRFTISSDNSKNTLYLQMNSLRAEDTAVYYCAKDRSYVSSSGYHFNLWGQGTLVTVSS

SEQ ID NO: 1835 - protein, 500 aa, Artificial Sequence
  Synthetic polypeptide
DIQMTQSPSSLSASVGDRVTITCQASETIYSSLAWYQQKPGKAPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWVGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1836 - protein, 5 aa, Artificial Sequence
  Synthetic polypeptide
SYVMH

SEQ ID NO: 1837 - protein, 17 aa, Artificial Sequence
  Synthetic polypeptide
YINPYNDGTKYNEKFQG

SEQ ID NO: 1838 - protein, 12 aa, Artificial Sequence
  Synthetic polypeptide
GTYYYGTRVFDY

SEQ ID NO: 1839 - protein, 16 aa, Artificial Sequence
  Synthetic polypeptide
RSSKSLQNSNGNTYLY

SEQ ID NO: 1840 - protein, 7 aa, Artificial Sequence
  Synthetic polypeptide
RMSNLNS

SEQ ID NO: 1841 - protein, 9 aa, Artificial Sequence
  Synthetic polypeptide
MQHLEYPIT

SEQ ID NO: 1842 - protein, 121 aa, Artificial Sequence
  Synthetic polypeptide
EVQLVESGGGLVKPGGSLKLSCAASGYTFTSYVMHWVRQAPGKGLEWIGYINPYNDGTKYNEKFQGRVTISSDKSISTAYMELSSLRESDTAMYYCARGTYYYGTRVFDYWGQGTLVTVSS

SEQ ID NO: 1843 - protein, 112 aa, Artificial Sequence
  Synthetic polypeptide
DIVMTQSPATLSLSPGERATLSCRSSKSLQNSNGNTYLYWFQQKPGQSPQLLIYRMSNLNSGVPDRFSGSGSGTEFTLTISSLEPEDFAVYYCMQHLEYPITFGAGTKLEIK

SEQ ID NO: 1844 - protein, 248 aa, Artificial Sequence
  Synthetic polypeptide
DIVMTQSPATLSLSPGERATLSCRSSKSLQNSNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRESDTAMYYCARGTYYYGTRVFDYWGQGTLVTVSS

SEQ ID NO: 1845 - protein, 502 aa, Artificial Sequence
  Synthetic polypeptide
DIVMTQSPATLSLSPGERATLSCRSSKSLQNSNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRESDTAMYYCARGTYYYGTRVFDYWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1846 - protein, 5 aa, Artificial Sequence
  Synthetic polypeptide
NYGMH

SEQ ID NO: 1847 - protein, 17 aa, Artificial Sequence
  Synthetic polypeptide
VISYDGSNKYYAEPVKG

SEQ ID NO: 1848 - protein, 13 aa, Artificial Sequence
  Synthetic polypeptide
DRGTIFGYYGMDV

SEQ ID NO: 1849 - protein, 16 aa, Artificial Sequence
  Synthetic polypeptide
RSSQSLLHSNGYNYLD

SEQ ID NO: 1850 - protein, 7 aa, Artificial Sequence
  Synthetic polypeptide
LGSNRAS

SEQ ID NO: 1851 - protein, 9 aa, Artificial Sequence
  Synthetic polypeptide
MQALQTPFT

SEQ ID NO: 1852 - protein, 117 aa, Artificial Sequence
  Synthetic polypeptide
ESGGGVVQPGRSLRLSCEASGFIVSNYGMHWVRQAPGKGLEWVAVISYDGSNKYYAEPVKGRFTISRDKSKNTVSLQMSSLRAEDTALYYCARDRGTIFGYYGMDVWGQGTTVTVSS

SEQ ID NO: 1853 - protein, 112 aa, Artificial Sequence
  Synthetic polypeptide
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGTKVEIK

SEQ ID NO: 1854 - protein, 249 aa, Artificial Sequence
  Synthetic polypeptide
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGTKVEIKGGGGSGGGGSGGGGSQVQLVESGGGVVQPGRSLRLSCEASGFIVSNYGMHWVRQAPGKGLEWVAVISYDGSNKYYAEPVKGRFTISRDKSKNTVSLQMSSLRAEDTALYYCARDRGTIFGYYGMDVWGQGTTVTVSS

SEQ ID NO: 1855 - protein, 503 aa, Artificial Sequence
  Synthetic polypeptide
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGTKVEIKGGGGSGGGGSGGGGSQVQLVESGGGVVQPGRSLRLSCEASGFIVSNYGMHWVRQAPGKGLEWVAVISYDGSNKYYAEPVKGRFTISRDKSKNTVSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1856 - protein, 5 aa, Artificial Sequence
  Synthetic polypeptide
NYGMH

SEQ ID NO: 1857 - protein, 17 aa, Artificial Sequence
  Synthetic polypeptide
VISYDGSNKYYAEPVKG

SEQ ID NO: 1858 - protein, 13 aa, Artificial Sequence
  Synthetic polypeptide
DRGTIFGYYGMDV

SEQ ID NO: 1859 - protein, 16 aa, Artificial Sequence
  Synthetic polypeptide
RSSQSLLHSNGFNYLD

SEQ ID NO: 1860 - protein, 7 aa, Artificial Sequence
  Synthetic polypeptide
LGSNRAS

SEQ ID NO: 1861 - protein, 9 aa, Artificial Sequence
  Synthetic polypeptide
MQALQTPLT

SEQ ID NO: 1862 - protein, 117 aa, Artificial Sequence
  Synthetic polypeptide
ESGGGVVQPGRSLRLSCEASGFIVSNYGMHWVRQAPGKGLEWVAVISYDGSNKYYAEPVKGRFTISRDKSKNTLSLQMSSLRAEDTALYYCARDRGTIFGYYGMDVWGQGTTVTVSS

SEQ ID NO: 1863 - protein, 112 aa, Artificial Sequence
  Synthetic polypeptide
DIVMTQSPLSLPVTPGEPASISCRSSQSLLHSNGFNYLDWYLQKPGQSPQLLIYLGSNRASGVPDRFSGSGSGTDFTLKISRVEAEDVGVYYCMQALQTPLTFAGGTKVEIK

SEQ ID NO: 1864 - protein, 249 aa, Artificial Sequence
  Synthetic polypeptide
DIVMTQSPLSLPVTPGEPASISCRSSQSLLHSNGFNYLDWYLQKPGQSPQLLIYLGSNRASGVPDRFSGSGSGTDFTLKISRVEAEDVGVYYCMQALQTPLTFAGGTKVEIKGGGGSGGGGSGGGGSQVQLVESGGGVVQPGRSLRLSCEASGFIVSNYGMHWVRQAPGKGLEWVAVISYDGSNKYYAEPVKGRFTISRDKSKNTLSLQMSSLRAEDTALYYCARDRGTIFGYYGMDVWGQGTTVTVSS

SEQ ID NO: 1865 - protein, 503 aa, Artificial Sequence
  Synthetic polypeptide
DIVMTQSPLSLPVTPGEPASISCRSSQSLLHSNGFNYLDWYLQKPGQSPQLLIYLGSNRASGVPDRFSGSGSGTDFTLKISRVEAEDVGVYYCMQALQTPLTFAGGTKVEIKGGGGSGGGGSGGGGSQVQLVESGGGVVQPGRSLRLSCEASGFIVSNYGMHWVRQAPGKGLEWVAVISYDGSNKYYAEPVKGRFTISRDKSKNTLSLQMSSLRAEDTALYYCARDRGTIFGYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1866 - protein, 5 aa, Artificial Sequence
  Synthetic polypeptide
SYNMH

SEQ ID NO: 1867 - protein, 17 aa, Artificial Sequence
  Synthetic polypeptide
AIYPLTGDTSYNQKSKL

SEQ ID NO: 1868 - protein, 12 aa, Artificial Sequence
  Synthetic polypeptide
STYVGGDWQFDV

SEQ ID NO: 1869 - protein, 10 aa, Artificial Sequence
  Synthetic polypeptide
RASSSVPYIH

SEQ ID NO: 1870 - protein, 7 aa, Artificial Sequence
  Synthetic polypeptide
ATSALAS

SEQ ID NO: 1871 - protein, 9 aa, Artificial Sequence
  Synthetic polypeptide
QQWLSNPPT

SEQ ID NO: 1872 - protein, 121 aa, Artificial Sequence
  Synthetic polypeptide
EVQLVQSGAEVKKPGESLKISCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSS

SEQ ID NO: 1873 - protein, 106 aa, Artificial Sequence
  Synthetic polypeptide
EIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLEIK

SEQ ID NO: 1874 - protein, 242 aa, Artificial Sequence
  Synthetic polypeptide
EVQLVQSGAEVKKPGESLKISCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSGGGGSGGGGSGGGGSEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLEIK

SEQ ID NO: 1875 - protein, 497 aa, Artificial Sequence
  Synthetic polypeptide
EVQLVQSGAEVKKPGESLKISCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSGGGGSGGGGSGGGGSEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1876 - protein, 5 aa, Artificial Sequence
  Synthetic polypeptide
YSWIN

SEQ ID NO: 1877 - protein, 17 aa, Artificial Sequence
  Synthetic polypeptide
RIFPGDGDTDYNGKFKG

SEQ ID NO: 1878 - protein, 10 aa, Artificial Sequence
  Synthetic polypeptide
NVFDGYWLVY

SEQ ID NO: 1879 - protein, 16 aa, Artificial Sequence
  Synthetic polypeptide
RSSKSLLHSNGITYLY

SEQ ID NO: 1880 - protein, 7 aa, Artificial Sequence
  Synthetic polypeptide
QMSNLVS

SEQ ID NO: 1881 - protein, 9 aa, Artificial Sequence
  Synthetic polypeptide
AQNLELPYT

SEQ ID NO: 1882 - protein, 119 aa, Artificial Sequence
  Synthetic polypeptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 1883 - protein, 112 aa, Artificial Sequence
  Synthetic polypeptide
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 1884 - protein, 246 aa, Artificial Sequence
  Synthetic polypeptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSGGGGSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 1885 - protein, 501 aa, Artificial Sequence
  Synthetic polypeptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSGGGGSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1886 - protein, 5 aa, Artificial Sequence
  Synthetic polypeptide
NYGMH

SEQ ID NO: 1887 - protein, 17 aa, Artificial Sequence
  Synthetic polypeptide
VIWYDGSDKYYADSVRG

SEQ ID NO: 1888 - protein, 15 aa, Artificial Sequence
  Synthetic polypeptide
DGYDILTGNPRDFDY

SEQ ID NO: 1889 - protein, 16 aa, Artificial Sequence
  Synthetic polypeptide
RSSQSLVHSDGNTYLS

SEQ ID NO: 1890 - protein, 7 aa, Artificial Sequence
  Synthetic polypeptide
RISRRFS

SEQ ID NO: 1891 - protein, 9 aa, Artificial Sequence
  Synthetic polypeptide
MQSTHVPRT

SEQ ID NO: 1892 - protein, 124 aa, Artificial Sequence
  Synthetic polypeptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSS

SEQ ID NO: 1893 - protein, 112 aa, Artificial Sequence
  Synthetic polypeptide
DTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIK

SEQ ID NO: 1894 - protein, 251 aa, Artificial Sequence
  Synthetic polypeptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIK

SEQ ID NO: 1895 - protein, 506 aa, Artificial Sequence
  Synthetic polypeptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1896 - protein, 5 aa, Artificial Sequence
  Synthetic polypeptide
NYGMH

SEQ ID NO: 1897 - protein, 17 aa, Artificial Sequence
  Synthetic polypeptide
VIWYDGSDKYYADSVRG

SEQ ID NO: 1898 - protein, 15 aa, Artificial Sequence
  Synthetic polypeptide
DGYDILTGNPRDFDY

SEQ ID NO: 1899 - protein, 16 aa, Artificial Sequence
  Synthetic polypeptide
RSSQSLVHSDGNTYLS

SEQ ID NO: 1900 - protein, 7 aa, Artificial Sequence
  Synthetic polypeptide
RISRRFS

SEQ ID NO: 1901 - protein, 9 aa, Artificial Sequence
  Synthetic polypeptide
MQSTHVPRT

SEQ ID NO: 1902 - protein, 124 aa, Artificial Sequence
  Synthetic polypeptide
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSS

SEQ ID NO: 1903 - protein, 112 aa, Artificial Sequence
  Synthetic polypeptide
DTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIK

SEQ ID NO: 1904 - protein, 251 aa, Artificial Sequence
  Synthetic polypeptide
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIK

SEQ ID NO: 1905 - protein, 506 aa, Artificial Sequence
  Synthetic polypeptide
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1906 - protein, 5 aa, Artificial Sequence
  Synthetic polypeptide
TYGMH

SEQ ID NO: 1907 - protein, 17 aa, Artificial Sequence
  Synthetic polypeptide
VIWYDGSNKYYGDSVKG

SEQ ID NO: 1908 - protein, 11 aa, Artificial Sequence
  Synthetic polypeptide
DNSHYYYGMDV

SEQ ID NO: 1909 - protein, 14 aa, Artificial Sequence
  Synthetic polypeptide
TGSSSNIGAGYDVN

SEQ ID NO: 1910 - protein, 7 aa, Artificial Sequence
  Synthetic polypeptide
VNNNRPS

SEQ ID NO: 1911 - protein, 11 aa, Artificial Sequence
  Synthetic polypeptide
QSYDTSLSASV

SEQ ID NO: 1912 - protein, 120 aa, Artificial Sequence
  Synthetic polypeptide
QVQLVESGGGVVQPGRSLRLSCAASGFTFSTYGMHWVRQAPGKGLEWVAVIWYDGSNKYYGDSVKGRFTISRDNSKNTLYLQMNSLRAEDTAVYYCARDNSHYYYGMDVWGQGTTVTVSS

SEQ ID NO: 1913 - protein, 111 aa, Artificial Sequence
  Synthetic polypeptide
QSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVL

SEQ ID NO: 1914 - protein, 247 aa, Artificial Sequence
  Synthetic polypeptide
QVQLVESGGGVVQPGRSLRLSCAASGFTFSTYGMHWVRQAPGKGLEWVAVIWYDGSNKYYGDSVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVLS

SEQ ID NO: 1915 - protein, 501 aa, Artificial Sequence
  Synthetic polypeptide
QVQLVESGGGVVQPGRSLRLSCAASGFTFSTYGMHWVRQAPGKGLEWVAVIWYDGSNKYYGDSVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYDTSLSASVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1916 - protein, 5 aa, Artificial Sequence
  Synthetic polypeptide
SYGMH

SEQ ID NO: 1917 - protein, 17 aa, Artificial Sequence
  Synthetic polypeptide
VIWYDGSDKYFADSVKG

SEQ ID NO: 1918 - protein, 13 aa, Artificial Sequence
  Synthetic polypeptide
DGIAGARYVYFDY

SEQ ID NO: 1919 - protein, 11 aa, Artificial Sequence
  Synthetic polypeptide
RASQGISNYLA

SEQ ID NO: 1920 - protein, 7 aa, Artificial Sequence
  Synthetic polypeptide
AASSLQG

SEQ ID NO: 1921 - protein, 9 aa, Artificial Sequence
  Synthetic polypeptide
QQYYNYPFT

SEQ ID NO: 1922 - protein, 122 aa, Artificial Sequence
  Synthetic polypeptide
QVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSS

SEQ ID NO: 1923 - protein, 107 aa, Artificial Sequence
  Synthetic polypeptide
DIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIK

SEQ ID NO: 1924 - protein, 244 aa, Artificial Sequence
  Synthetic polypeptide
QVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIK

SEQ ID NO: 1925 - protein, 499 aa, Artificial Sequence
  Synthetic polypeptide
QVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1926 - protein, 5 aa, Artificial Sequence
  Synthetic polypeptide
SYGMH

SEQ ID NO: 1927 - protein, 17 aa, Artificial Sequence
  Synthetic polypeptide
VTWYDGSNKYYGDSVKG

SEQ ID NO: 1928 - protein, 13 aa, Artificial Sequence
  Synthetic polypeptide
DLLRGVKGYAMDV

SEQ ID NO: 1929 - protein, 12 aa, Artificial Sequence
  Synthetic polypeptide
RASQSLRRIYLA

SEQ ID NO: 1930 - protein, 7 aa, Artificial Sequence
  Synthetic polypeptide
DVFDRAT

SEQ ID NO: 1931 - protein, 9 aa, Artificial Sequence
  Synthetic polypeptide
QQYSDSPFT

SEQ ID NO: 1932 - protein, 122 aa, Artificial Sequence
  Synthetic polypeptide
QEQLVESGGGVVQPGRSLRLSCAASGFTFSSYGMHWVRQAPGKGLEWVAVTWYDGSNKYYGDSVKGRFTISRDNSKNTLYLQMNSLRAEDTAVYYCARDLLRGVKGYAMDVWGQGTTVTVSS

SEQ ID NO: 1933 - protein, 108 aa, Artificial Sequence
  Synthetic polypeptide
EIVLTQSPGTLSLSPGERATLSCRASQSLRRIYLAWYQQKPGQAPRLLIYDVFDRATGIPDRFSGGGSGTDFTLTISRLEPEDFAVYYCQQYSDSPFTFGPGTKVDIK

SEQ ID NO: 1934 - protein, 245 aa, Artificial Sequence
  Synthetic polypeptide
QEQLVESGGGVVQPGRSLRLSCAASGFTFSSYGMHWVRQAPGKGLEWVAVTWYDGSNKYYGDSVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSDSPFTFGPGTKVDIK

SEQ ID NO: 1935 - protein, 500 aa, Artificial Sequence
  Synthetic polypeptide
QEQLVESGGGVVQPGRSLRLSCAASGFTFSSYGMHWVRQAPGKGLEWVAVTWYDGSNKYYGDSVKGRFTISRDNSKNTLYLQMNSLRAEDTAVYYCARDLLRGVKGYAMDVWGQGTTVTVSSGGGGSGGGGSGGGGSEIVLTQSPGTLSLSPGERATLSCRASQSLRRIYLAWYQQKPGQAPRLLIYDVFDRATGIPDRFSGGGSGTDFTLTISRLEPEDFAVYYCQQYSDSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1936 - protein, 5 aa, Artificial Sequence
  Synthetic polypeptide
SYGIS

SEQ ID NO: 1937 - protein, 17 aa, Artificial Sequence
  Synthetic polypeptide
WISAYNGYTHYAQKLQG

SEQ ID NO: 1938 - protein, 12 aa, Artificial Sequence
  Synthetic polypeptide
DYGGNDYYGMDV

SEQ ID NO: 1939 - protein, 13 aa, Artificial Sequence
  Synthetic polypeptide
SGSSSNIGINYVY

SEQ ID NO: 1940 - protein, 7 aa, Artificial Sequence
  Synthetic polypeptide
RSDQRPS

SEQ ID NO: 1941 - protein, 11 aa, Artificial Sequence
  Synthetic polypeptide
AAWDDSLSGVV

SEQ ID NO: 1942 - protein, 121 aa, Artificial Sequence
  Synthetic polypeptide
QVQLVQSGAEVKKPGASVKVSCKASGYTFTSYGISWVRQAPGQGLEWMGWISAYNGYTHYAQKLQGRVTMTTDTSTSTAYMELRSLRSDDTAVYYCARDYGGNDYYGMDVWGQGTTVTVSS

SEQ ID NO: 1943 - protein, 110 aa, Artificial Sequence
  Synthetic polypeptide
QSVLTQPPSASGTPGQRVTISCSGSSSNIGINYVYWYQQLPGTAPKLLIYRSDQRPSGVPDRFSGSKSGTSASLALSGLRSEDEADYYCAAWDDSLSGVVFGGGTKLTVL

SEQ ID NO: 1944 - protein, 246 aa, Artificial Sequence
  Synthetic polypeptide
QVQLVQSGAEVKKPGASVKVSCKASGYTFTSYGISWVRQAPGQGLEWMGWISAYNGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAWDDSLSGVVFGGGTKLTVL

SEQ ID NO: 1945 - protein, 501 aa, Artificial Sequence
  Synthetic polypeptide
QVQLVQSGAEVKKPGASVKVSCKASGYTFTSYGISWVRQAPGQGLEWMGWISAYNGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAWDDSLSGVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1946 - protein, 7 aa, Artificial Sequence
  Synthetic polypeptide
SGGYYWS

SEQ ID NO: 1947 - protein, 16 aa, Artificial Sequence
  Synthetic polypeptide
YIFYSGSTDYNPSLKS

SEQ ID NO: 1948 - protein, 10 aa, Artificial Sequence
  Synthetic polypeptide
SGYSYALFDH

SEQ ID NO: 1949 - protein, 11 aa, Artificial Sequence
  Synthetic polypeptide
RASQFIGRYFN

SEQ ID NO: 1950 - protein, 7 aa, Artificial Sequence
  Synthetic polypeptide
AESSLQS

SEQ ID NO: 1951 - protein, 9 aa, Artificial Sequence
  Synthetic polypeptide
QQSYSTPWT

SEQ ID NO: 1952 - protein, 120 aa, Artificial Sequence
  Synthetic polypeptide
QVQLQESGPGLVKPSQTLSLTCTVSGDSIISGGYYWSWIRQHPGKGLEWIGYIFYSGSTDYNPSLKSRVTISVDTSKNQFSLKLSSVTAADTAVYYCARSGYSYALFDHWGQGTLVTVSS

SEQ ID NO: 1953 - protein, 107 aa, Artificial Sequence
  Synthetic polypeptide
DIQMTQSPSSLSASVGDRVTISCRASQFIGRYFNWYQQQPGKAPKVLIYAESSLQSGVPSRFSGSGSGTEFTLTISSLQPEDFARYYCQQSYSTPWTFGQGTKVEIK

SEQ ID NO: 1954 - protein, 242 aa, Artificial Sequence
  Synthetic polypeptide
QVQLQESGPGLVKPSQTLSLTCTVSGDSIISGGYYWSWIRQHPGKGLEWIGYIFYSGSTDYNPSLKSRVTISVDTSKNQFSLKLSSVTAADTAVYYCARSGYSYALFDHWGQGTLVTVSSGGGGSGGGGSGGGGSDIQMTQSPSSLSASVGDRVTISCRASQFIGRYFNWYQQQPGKAPKVLIYAESSLQSGVPSRFSGSGSGTEFTLTISSLQPEDFARYYCQQSYSTPWTFGQGTKVEIK

SEQ ID NO: 1955 - protein, 497 aa, Artificial Sequence
  Synthetic polypeptide
QVQLQESGPGLVKPSQTLSLTCTVSGDSIISGGYYWSWIRQHPGKGLEWIGYIFYSGSTDYNPSLKSRVTISVDTSKNQFSLKLSSVTAADTAVYYCARSGYSYALFDHWGQGTLVTVSSGGGGSGGGGSGGGGSDIQMTQSPSSLSASVGDRVTISCRASQFIGRYFNWYQQQPGKAPKVLIYAESSLQSGVPSRFSGSGSGTEFTLTISSLQPEDFARYYCQQSYSTPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1956 - protein, 7 aa, Artificial Sequence
  Synthetic polypeptide
SGGYYWS

SEQ ID NO: 1957 - protein, 16 aa, Artificial Sequence
  Synthetic polypeptide
YIFYSGSTDYNPSLKS

SEQ ID NO: 1958 - protein, 10 aa, Artificial Sequence
  Synthetic polypeptide
SGYSYALFDH

SEQ ID NO: 1959 - protein, 11 aa, Artificial Sequence
  Synthetic polypeptide
RASQFIGRYFN

SEQ ID NO: 1960 - protein, 7 aa, Artificial Sequence
  Synthetic polypeptide
AESSLQS

SEQ ID NO: 1961 - protein, 9 aa, Artificial Sequence
  Synthetic polypeptide
QQSYSTPFT

SEQ ID NO: 1962 - protein, 120 aa, Artificial Sequence
  Synthetic polypeptide
QVQLQESGPGLVKPSQTLSLTCTVSGDSIISGGYYWSWIRQHPGKCLEWIGYIFYSGSTDYNPSLKSRVTISVDTSKNQFSLKLSSVTAADTAVYYCARSGYSYALFDHWGQGTLVTVSS

SEQ ID NO: 1963 - protein, 107 aa, Artificial Sequence
  Synthetic polypeptide
DIQMTQSPSSLSASVGDRVTISCRASQFIGRYFNWYQQQPGKAPKVLIYAESSLQSGVPSRFSGSGSGTEFTLTISSLQPEDFARYYCQQSYSTPFTFGCGTKVEIK

SEQ ID NO: 1964 - protein, 242 aa, Artificial Sequence
  Synthetic polypeptide
QVQLQESGPGLVKPSQTLSLTCTVSGDSIISGGYYWSWIRQHPGKCLEWIGYIFYSGSTDYNPSLKSRVTISVDTSKNQFSLKLSSVTAADTAVYYCARSGYSYALFDHWGQGTLVTVSSGGGGSGGGGSGGGGSDIQMTQSPSSLSASVGDRVTISCRASQFIGRYFNWYQQQPGKAPKVLIYAESSLQSGVPSRFSGSGSGTEFTLTISSLQPEDFARYYCQQSYSTPFTFGCGTKVEIK

SEQ ID NO: 1965 - protein, 497 aa, Artificial Sequence
  Synthetic polypeptide
QVQLQESGPGLVKPSQTLSLTCTVSGDSIISGGYYWSWIRQHPGKCLEWIGYIFYSGSTDYNPSLKSRVTISVDTSKNQFSLKLSSVTAADTAVYYCARSGYSYALFDHWGQGTLVTVSSGGGGSGGGGSGGGGSDIQMTQSPSSLSASVGDRVTISCRASQFIGRYFNWYQQQPGKAPKVLIYAESSLQSGVPSRFSGSGSGTEFTLTISSLQPEDFARYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1966 - protein, 5 aa, Artificial Sequence
  Synthetic polypeptide
SYYLH

SEQ ID NO: 1967 - protein, 17 aa, Artificial Sequence
  Synthetic polypeptide
IVDPSGGSTSYDQKFQG

SEQ ID NO: 1968 - protein, 9 aa, Artificial Sequence
  Synthetic polypeptide
DYGDYVFDY

SEQ ID NO: 1969 - protein, 13 aa, Artificial Sequence
  Synthetic polypeptide
SGSSSNIGTNTVN

SEQ ID NO: 1970 - protein, 7 aa, Artificial Sequence
  Synthetic polypeptide
INNQRPS

SEQ ID NO: 1971 - protein, 11 aa, Artificial Sequence
  Synthetic polypeptide
ATWDDSLNGPV

SEQ ID NO: 1972 - protein, 118 aa, Artificial Sequence
  Synthetic polypeptide
QVHLVQSGAEVKKPGASVRVSCKASGYTFTSYYLHWVRQAPGQCLEWMGIVDPSGGSTSYDQKFQGRFTMTRDTSTSTVYMELSSLRSEDTAVYYCARDYGDYVFDYWGQGTLVTVSS

SEQ ID NO: 1973 - protein, 110 aa, Artificial Sequence
  Synthetic polypeptide
QSVLTQPPSASGTPGQRVTISCSGSSSNIGTNTVNWYQQLPGTAPQLLIYINNQRPSGVPDRFSGSKSGTSASLAISGLQSEDEADYYCATWDDSLNGPVVGCGTKLTVL

SEQ ID NO: 1974 - protein, 243 aa, Artificial Sequence
  Synthetic polypeptide
QVHLVQSGAEVKKPGASVRVSCKASGYTFTSYYLHWVRQAPGQCLEWMGIVDPSGGSTSYDQKFQGRFTMTRDTSTSTVYMELSSLRSEDTAVYYCARDYGDYVFDYWGQGTLVTVSSGGGGSGGGGSGGGGSQSVLTQPPSASGTPGQRVTISCSGSSSNIGTNTVNWYQQLPGTAPQLLIYINNQRPSGVPDRFSGSKSGTSASLAISGLQSEDEADYYCATWDDSLNGPVVGCGTKLTVL

SEQ ID NO: 1975 - protein, 498 aa, Artificial Sequence
  Synthetic polypeptide
QVHLVQSGAEVKKPGASVRVSCKASGYTFTSYYLHWVRQAPGQCLEWMGIVDPSGGSTSYDQKFQGRFTMTRDTSTSTVYMELSSLRSEDTAVYYCARDYGDYVFDYWGQGTLVTVSSGGGGSGGGGSGGGGSQSVLTQPPSASGTPGQRVTISCSGSSSNIGTNTVNWYQQLPGTAPQLLIYINNQRPSGVPDRFSGSKSGTSASLAISGLQSEDEADYYCATWDDSLNGPVVGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1976 - protein, 5 aa, Artificial Sequence
  Synthetic polypeptide
SYGMH

SEQ ID NO: 1977 - protein, 17 aa, Artificial Sequence
  Synthetic polypeptide
VIWYDGSDKYFADSVKG

SEQ ID NO: 1978 - protein, 13 aa, Artificial Sequence
  Synthetic polypeptide
DGIAGARYVYFDY

SEQ ID NO: 1979 - protein, 11 aa, Artificial Sequence
  Synthetic polypeptide
RASQGISNYLA

SEQ ID NO: 1980 - protein, 7 aa, Artificial Sequence
  Synthetic polypeptide
AASSLQG

SEQ ID NO: 1981 - protein, 9 aa, Artificial Sequence
  Synthetic polypeptide
QQYYNYPFT

SEQ ID NO: 1982 - protein, 122 aa, Artificial Sequence
  Synthetic polypeptide
QVQLVESGGGVVQPGRSLRLSCAASGFTFSSYGMHWVRQAPGKCLEWVAVIWYDGSDKYFADSVKGRFTISRDNSKNTLYLQMNSLRAEDTAVYYCARDGIAGARYVYFDYWGQGTLVTVSS

SEQ ID NO: 1983 - protein, 107 aa, Artificial Sequence
  Synthetic polypeptide
DIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGCGTTVDIK

SEQ ID NO: 1984 - protein, 244 aa, Artificial Sequence
  Synthetic polypeptide
QVQLVESGGGVVQPGRSLRLSCAASGFTFSSYGMHWVRQAPGKCLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGCGTTVDIK

SEQ ID NO: 1985 - protein, 499 aa, Artificial Sequence
  Synthetic polypeptide
QVQLVESGGGVVQPGRSLRLSCAASGFTFSSYGMHWVRQAPGKCLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGCGTTVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1986 - protein, 5 aa, Artificial Sequence
  Synthetic polypeptide
SYGIS

SEQ ID NO: 1987 - protein, 17 aa, Artificial Sequence
  Synthetic polypeptide
WISAYNGYTHYAQKLQG

SEQ ID NO: 1988 - protein, 12 aa, Artificial Sequence
  Synthetic polypeptide
DYGGNDYYGMDV

SEQ ID NO: 1989 - protein, 13 aa, Artificial Sequence
  Synthetic polypeptide
SGSSSNIGINYVY

SEQ ID NO: 1990 - protein, 7 aa, Artificial Sequence
  Synthetic polypeptide
RSDQRPS

SEQ ID NO: 1991 - protein, 11 aa, Artificial Sequence
  Synthetic polypeptide
AAWDDSLSGVV

SEQ ID NO: 1992 - protein, 121 aa, Artificial Sequence
  Synthetic polypeptide
QVQLVQSGAEVKKPGASVKVSCKASGYTFTSYGISWVRQAPGQCLEWMGWISAYNGYTHYAQKLQGRVTMTTDTSTSTAYMELRSLRSDDTAVYYCARDYGGNDYYGMDVWGQGTTVTVSS

SEQ ID NO: 1993 - protein, 110 aa, Artificial Sequence
  Synthetic polypeptide
QSVLTQPPSASGTPGQRVTISCSGSSSNIGINYVYWYQQLPGTAPKLLIYRSDQRPSGVPDRFSGSKSGTSASLALSGLRSEDEADYYCAAWDDSLSGVVFGCGTKLTVL

SEQ ID NO: 1994 - protein, 246 aa, Artificial Sequence
  Synthetic polypeptide
QVQLVQSGAEVKKPGASVKVSCKASGYTFTSYGISWVRQAPGQCLEWMGWISAYNGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAWDDSLSGVVFGCGTKLTVL

SEQ ID NO: 1995 - protein, 501 aa, Artificial Sequence
  Synthetic polypeptide
QVQLVQSGAEVKKPGASVKVSCKASGYTFTSYGISWVRQAPGQCLEWMGWISAYNGYTHYAQKLQGRVTMTTDTSTSTAYMELRSLRSDDTAVYYCARDYGGNDYYGMDVWGQGTTVTVSSGGGGSGGGGSGGGGSQSVLTQPPSASGTPGQRVTISCSGSSSNIGINYVYWYQQLPGTAPKLLIYRSDQRPSGVPDRFSGSKSGTSASLALSGLRSEDEADYYCAAWDDSLSGVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1996 - protein, 7 aa, Artificial Sequence
  Synthetic polypeptide
SGGYYWS

SEQ ID NO: 1997 - protein, 16 aa, Artificial Sequence
  Synthetic polypeptide
YIFYSGSTDYNPSLKS

SEQ ID NO: 1998 - protein, 10 aa, Artificial Sequence
  Synthetic polypeptide
SGYSYALFDH

SEQ ID NO: 1999 - protein, 11 aa, Artificial Sequence
  Synthetic polypeptide
RASQFIGRYFN

SEQ ID NO: 2000 - protein, 7 aa, Artificial Sequence
  Synthetic polypeptide
AESSLQS

SEQ ID NO: 2001 - protein, 9 aa, Artificial Sequence
  Synthetic polypeptide
QQSYSTPWT

SEQ ID NO: 2002 - protein, 120 aa, Artificial Sequence; identical to SEQ ID NO: 1962
  Synthetic polypeptide

SEQ ID NO: 2003 - protein, 107 aa, Artificial Sequence
  Synthetic polypeptide
DIQMTQSPSSLSASVGDRVTISCRASQFIGRYFNWYQQQPGKAPKVLIYAESSLQSGVPSRFSGSGSGTEFTLTISSLQPEDFARYYCQQSYSTPWTFGCGTKVEIK

SEQ ID NO: 2004 - protein, 242 aa, Artificial Sequence
  Synthetic polypeptide
QVQLQESGPGLVKPSQTLSLTCTVSGDSIISGGYYWSWIRQHPGKCLEWIGYIFYSGSTDYNPSLKSRVTISVDTSKNQFSLKLSSVTAADTAVYYCARSGYSYALFDHWGQGTLVTVSSGGGGSGGGGSGGGGSDIQMTQSPSSLSASVGDRVTISCRASQFIGRYFNWYQQQPGKAPKVLIYAESSLQSGVPSRFSGSGSGTEFTLTISSLQPEDFARYYCQQSYSTPWTFGCGTKVEIK

SEQ ID NO: 2005 - protein, 497 aa, Artificial Sequence
  Synthetic polypeptide
QVQLQESGPGLVKPSQTLSLTCTVSGDSIISGGYYWSWIRQHPGKCLEWIGYIFYSGSTDYNPSLKSRVTISVDTSKNQFSLKLSSVTAADTAVYYCARSGYSYALFDHWGQGTLVTVSSGGGGSGGGGSGGGGSDIQMTQSPSSLSASVGDRVTISCRASQFIGRYFNWYQQQPGKAPKVLIYAESSLQSGVPSRFSGSGSGTEFTLTISSLQPEDFARYYCQQSYSTPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2006 - protein, 5 aa, Artificial Sequence
  Synthetic polypeptide
TYGMH

SEQ ID NO: 2007 - protein, 17 aa, Artificial Sequence
  Synthetic polypeptide
VIWYDGSNKYYGDSVKG

SEQ ID NO: 2008 - protein, 11 aa, Artificial Sequence
  Synthetic polypeptide
DNSHYYYGMDV

SEQ ID NO: 2009 - protein, 14 aa, Artificial Sequence
  Synthetic polypeptide
TGSSSNIGAGYDVN

SEQ ID NO: 2010 - protein, 7 aa, Artificial Sequence
  Synthetic polypeptide
VNNNRPS

SEQ ID NO: 2011 - protein, 11 aa, Artificial Sequence
  Synthetic polypeptide
QSYETSLSASV

SEQ ID NO: 2012 - protein, 120 aa, Artificial Sequence
  Synthetic polypeptide
QVQLVESGGGVVQPGRSLRLSCAASGFTFSTYGMHWVRQAPGKCLEWVAVIWYDGSNKYYGDSVKGRFTISRDNSKNTLYLQMNSLRAEDTAVYYCARDNSHYYYGMDVWGQGTTVTVSS

SEQ ID NO: 2013 - protein, 111 aa, Artificial Sequence
  Synthetic polypeptide
QSVLTQPPSVSGAPGQRVTISCTGSSSNIGAGYDVNWYQQFPGTAPKLLIYVNNNRPSGVPDRFSGSTSGTSASLAITGLQAEDEADYYCQSYETSLSASVFGCGTRLTVL

SEQ ID NO: 2014 - protein, 246 aa, Artificial Sequence
  Synthetic polypeptide
QVQLVESGGGVVQPGRSLRLSCAASGFTFSTYGMHWVRQAPGKCLEWVAVIWYDGSNKYYGDSVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYETSLSASVFGCGTRLTVL

SEQ ID NO: 2015 - protein, 501 aa, Artificial Sequence
  Synthetic polypeptide
QVQLVESGGGVVQPGRSLRLSCAASGFTFSTYGMHWVRQAPGKCLEWVAVIWYDGSNKYYGDSVKGRFTISRDNSKNTLYLQMNSLRAEDTAVYYCARDNSHYYYGMDVWGQGTTVTVSSGGGGSGGGGSGGGGSQSVLTQPPSVSGAPGQRVTISCTGSSSNIGAGYDVNWYQQFPGTAPKLLIYVNNNRPSGVPDRFSGSTSGTSASLAITGLQAEDEADYYCQSYETSLSASVFGCGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2016 - protein, 5 aa, Artificial Sequence
  Synthetic polypeptide
YYGMH

SEQ ID NO: 2017 - protein, 17 aa, Artificial Sequence
  Synthetic polypeptide
VIWYDGSNKYYADSVKG

SEQ ID NO: 2018 - protein, 12 aa, Artificial Sequence
  Synthetic polypeptide
DREMGSRGDFDY

SEQ ID NO: 2019 - protein, 11 aa, Artificial Sequence
  Synthetic polypeptide
RASQGINNYLA

SEQ ID NO: 2020 - protein, 7 aa, Artificial Sequence
  Synthetic polypeptide
AVSILQS

SEQ ID NO: 2021 - protein, 9 aa, Artificial Sequence
  Synthetic polypeptide
QQYNFYPFS

SEQ ID NO: 2022 - protein, 121 aa, Artificial Sequence
  Synthetic polypeptide
QAQLVESGGGVVQPGRSLRLSCAASGFTFSYYGMHWVRQAPGKCLEWVAVIWYDGSNKYYADSVKGRFTISRDNSKNTLYLQMNSLRAEDTAVYYCARDREMGSRGDFDYWGQGTLVTVSS

SEQ ID NO: 2023 - protein, 107 aa, Artificial Sequence
  Synthetic polypeptide
DIQMTQSPSSLSASVGDRVTITCRASQGINNYLAWFQQKPGKAPKSLIYAVSILQSGVPSKFSGSGSGTDFTLTIGNLQPEDFATYYCQQYNFYPFSFGCGTKVDIK

SEQ ID NO: 2024 - protein, 243 aa, Artificial Sequence
  Synthetic polypeptide
QAQLVESGGGVVQPGRSLRLSCAASGFTFSYYGMHWVRQAPGKCLEWVAVIWYDGSNKYYADSVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTIGNLQPEDFATYYCQQYNFYPFSFGCGTKVDIK

SEQ ID NO: 2025 - protein, 498 aa, Artificial Sequence
  Synthetic polypeptide
QAQLVESGGGVVQPGRSLRLSCAASGFTFSYYGMHWVRQAPGKCLEWVAVIWYDGSNKYYADSVKGRFTISRDNSKNTLYLQMNSLRAEDTAVYYCARDREMGSRGDFDYWGQGTLVTVSSGGGGSGGGGSGGGGSDIQMTQSPSSLSASVGDRVTITCRASQGINNYLAWFQQKPGKAPKSLIYAVSILQSGVPSKFSGSGSGTDFTLTIGNLQPEDFATYYCQQYNFYPFSFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2026 - protein, 5 aa, Artificial Sequence
  Synthetic polypeptide
SYAMS

SEQ ID NO: 2027 - protein, 17 aa, Artificial Sequence
  Synthetic polypeptide
VISGSGGRPNYADSVKG

SEQ ID NO: 2028 - protein, 11 aa, Artificial Sequence
  Synthetic polypeptide
VDYSNYLFFDY

SEQ ID NO: 2029 - protein, 12 aa, Artificial Sequence
  Synthetic polypeptide
RAGQSVRSSYLG

SEQ ID NO: 2030 - protein, 7 aa, Artificial Sequence
  Synthetic polypeptide
GASSRAT

SEQ ID NO: 2031 - protein, 9 aa, Artificial Sequence
  Synthetic polypeptide
QQYGYSPPT

SEQ ID NO: 2032 - protein, 120 aa, Artificial Sequence
  Synthetic polypeptide
EVQLLESGGGLVQPGGSLRLSCAASGFTFSSYAMSWVRQAPGKGLEWVSVISGSGGRPNYADSVKGRFTISRDNSKNTLYLQMNSLRDEDTAVYYCAKVDYSNYLFFDYWGQGTLVTVSS

SEQ ID NO: 2033 - protein, 108 aa, Artificial Sequence
  Synthetic polypeptide
EIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIK

SEQ ID NO: 2034 - protein, 243 aa, Artificial Sequence
  Synthetic polypeptide
EVQLLESGGGLVQPGGSLRLSCAASGFTFSSYAMSWVRQAPGKGLEWVSVISGSGGRPNYADSVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIK

SEQ ID NO: 2035 - protein, 498 aa, Artificial Sequence
  Synthetic polypeptide
EVQLLESGGGLVQPGGSLRLSCAASGFTFSSYAMSWVRQAPGKGLEWVSVISGSGGRPNYADSVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2036 - protein, 5 aa, Artificial Sequence
  Synthetic polypeptide
IYAMS

SEQ ID NO: 2037 - protein, 17 aa, Artificial Sequence
  Synthetic polypeptide
AISGSGGSTFYADSVKG

SEQ ID NO: 2038 - protein, 11 aa, Artificial Sequence
  Synthetic polypeptide
HDYSNYPYFDY

SEQ ID NO: 2039 - protein, 12 aa, Artificial Sequence
  Synthetic polypeptide
RASQSVRSSYLA

SEQ ID NO: 2040 - protein, 7 aa, Artificial Sequence
  Synthetic polypeptide
GASSRAT

SEQ ID NO: 2041 - protein, 9 aa, Artificial Sequence
  Synthetic polypeptide
QQYGDLPFT

SEQ ID NO: 2042 - protein, 120 aa, Artificial Sequence
  Synthetic polypeptide
EVQLLESGGGLVQPGGSLKLSCAASGFTFSIYAMSWVRQAPGKGLEWVSAISGSGGSTFYADSVKGRFTISRDNSKNTLYLQMNSLRAEDTAVYYCAKHDYSNYPYFDYWGQGTLVTVSS

SEQ ID NO: 2043 - protein, 108 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIK

SEQ ID NO: 2044 - protein, 243 aa, Artificial Sequence
  Synthetic polypeptide
EVQLLESGGGLVQPGGSLKLSCAASGFTFSIYAMSWVRQAPGKGLEWVSAISGSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIK

SEQ ID NO: 2045 - protein, 498 aa, Artificial Sequence
  Synthetic polypeptide
EVQLLESGGGLVQPGGSLKLSCAASGFTFSIYAMSWVRQAPGKGLEWVSAISGSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2046 - protein, 5 aa, Artificial Sequence
  Synthetic polypeptide
SYAMS

SEQ ID NO: 2047 - protein, 17 aa, Artificial Sequence
  Synthetic polypeptide
AISGSGGRTFYADSVEG

SEQ ID NO: 2048 - protein, 11 aa, Artificial Sequence
  Synthetic polypeptide
HDYSNYPYFDY

SEQ ID NO: 2049 - protein, 12 aa, Artificial Sequence
  Synthetic polypeptide
RASQSVRSSYLA

SEQ ID NO: 2050 - protein, 7 aa, Artificial Sequence
  Synthetic polypeptide
GASSRAT

SEQ ID NO: 2051 - protein, 9 aa, Artificial Sequence
  Synthetic polypeptide
QQYGSSPFT

SEQ ID NO: 2052 - protein, 120 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLFLQMNSLRAEDTAVYYCAKHDYSNYPYFDYWGQGTLVTVSS

SEQ ID NO: 2053 - protein, 108 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIK

SEQ ID NO: 2054 - protein, 243 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIK

SEQ ID NO: 2055 - protein, 498 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLFLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2056 - protein, 5 aa, Artificial Sequence
  Synthetic polypeptide
SYAMS

SEQ ID NO: 2057 - protein, 17 aa, Artificial Sequence
  Synthetic polypeptide
AISGSGGRTFYADSVEG

SEQ ID NO: 2058 - protein, 11 aa, Artificial Sequence
  Synthetic polypeptide
HDYSNYPYFDY

SEQ ID NO: 2059 - protein, 12 aa, Artificial Sequence
  Synthetic polypeptide
RASQSIRSSYLA

SEQ ID NO: 2060 - protein, 7 aa, Artificial Sequence
  Synthetic polypeptide
GASSRAT

SEQ ID NO: 2061 - protein, 9 aa, Artificial Sequence
  Synthetic polypeptide
QQYGDLPFT

SEQ ID NO: 2062 - protein, 120 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSS

SEQ ID NO: 2063 - protein, 108 aa, Artificial Sequence
  Synthetic polypeptide
EIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIK

SEQ ID NO: 2064 - protein, 243 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIK

SEQ ID NO: 2065 - protein, 498 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2066 - protein, 5 aa, Artificial Sequence
  Synthetic polypeptide
SYAMS

SEQ ID NO: 2067 - protein, 17 aa, Artificial Sequence
  Synthetic polypeptide
AISGSGGRTHYADSVKG

SEQ ID NO: 2068 - protein, 11 aa, Artificial Sequence
  Synthetic polypeptide
HDYSNYPYFDY

SEQ ID NO: 2069 - protein, 12 aa, Artificial Sequence
  Synthetic polypeptide
RASQSVRSSYLA

SEQ ID NO: 2070 - protein, 7 aa, Artificial Sequence
  Synthetic polypeptide
GASSRAT

SEQ ID NO: 2071 - protein, 9 aa, Artificial Sequence
  Synthetic polypeptide
QQYGSSPFT

SEQ ID NO: 2072 - protein, 120 aa, Artificial Sequence
  Synthetic polypeptide
EVQLLESGGGLVQSGGSLRLSCAASGFTFSSYAMSWVRQAPGKGLEWVSAISGSGGRTHYADSVKGRFTISRDNSKNTLYLQMNSLRAEDTAVYYCAKHDYSNYPYFDYWGQGTLVTVSS

SEQ ID NO: 2073 - protein, 108 aa, Artificial Sequence; identical to SEQ ID NO: 2053
  Synthetic polypeptide

SEQ ID NO: 2074 - protein, 243 aa, Artificial Sequence
  Synthetic polypeptide
EVQLLESGGGLVQSGGSLRLSCAASGFTFSSYAMSWVRQAPGKGLEWVSAISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIK

SEQ ID NO: 2075 - protein, 498 aa, Artificial Sequence
  Synthetic polypeptide
EVQLLESGGGLVQSGGSLRLSCAASGFTFSSYAMSWVRQAPGKGLEWVSAISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2076 - protein, 5 aa, Artificial Sequence
  Synthetic polypeptide
SYAMS

SEQ ID NO: 2077 - protein, 17 aa, Artificial Sequence
  Synthetic polypeptide
LISGSGGRTHYADSVKG

SEQ ID NO: 2078 - protein, 11 aa, Artificial Sequence
  Synthetic polypeptide
HDYSNYPYFDY

SEQ ID NO: 2079 - protein, 12 aa, Artificial Sequence
  Synthetic polypeptide
RASQSVRSTYLA

SEQ ID NO: 2080 - protein, 7 aa, Artificial Sequence
  Synthetic polypeptide
DASSRAT

SEQ ID NO: 2081 - protein, 9 aa, Artificial Sequence
  Synthetic polypeptide
QQYGSSPPT

SEQ ID NO: 2082 - protein, 120 aa, Artificial Sequence
  Synthetic polypeptide
EVQLLESGGGLVQPGGSLRLSCAASGFTFSSYAMSWVRQAPGKGLEWVSLISGSGGRTHYADSVKGRFTISRDNSKNTLYLQMNSLRAEDTAVYYCAKHDYSNYPYFDYWGQGTLVTVSS

SEQ ID NO: 2083 - protein, 108 aa, Artificial Sequence
  Synthetic polypeptide
EIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIK

SEQ ID NO: 2084 - protein, 243 aa, Artificial Sequence
  Synthetic polypeptide
EVQLLESGGGLVQPGGSLRLSCAASGFTFSSYAMSWVRQAPGKGLEWVSLISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIK

SEQ ID NO: 2085 - protein, 498 aa, Artificial Sequence
  Synthetic polypeptide
EVQLLESGGGLVQPGGSLRLSCAASGFTFSSYAMSWVRQAPGKGLEWVSLISGSGGRTHYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYDASSRATGIPDRFSGSGSGTDFTLTISRLEPEDFAVYFCQQYGSSPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2086 - protein, 5 aa, Artificial Sequence
  Synthetic polypeptide
TYAMS

SEQ ID NO: 2087 - protein, 17 aa, Artificial Sequence
  Synthetic polypeptide
AISGSGGSTFYADSVKG

SEQ ID NO: 2088 - protein, 11 aa, Artificial Sequence
  Synthetic polypeptide
HDYSNYPYFDY

SEQ ID NO: 2089 - protein, 12 aa, Artificial Sequence
  Synthetic polypeptide
RASQSVRSSYLA

SEQ ID NO: 2090 - protein, 7 aa, Artificial Sequence
  Synthetic polypeptide
GASSRAT

SEQ ID NO: 2091 - protein, 9 aa, Artificial Sequence
  Synthetic polypeptide
QQYGDLPFT

SEQ ID NO: 2092 - protein, 120 aa, Artificial Sequence
  Synthetic polypeptide
EVQLLESGGGLVQPGGSLRLSCAASGFTFSTYAMSWVRQAPGKGLEWVSAISGSGGSTFYADSVKGRFTISRDNSKNTLSLQMNSLRAEDTAVYYCAKHDYSNYPYFDYWGQGTLVTVSS

SEQ ID NO: 2093 - protein, 108 aa, Artificial Sequence; identical to SEQ ID NO: 2043
  Synthetic polypeptide

SEQ ID NO: 2094 - protein, 243 aa, Artificial Sequence
  Synthetic polypeptide
EVQLLESGGGLVQPGGSLRLSCAASGFTFSTYAMSWVRQAPGKGLEWVSAISGSGGSTFYADSVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIK

SEQ ID NO: 2095 - protein, 498 aa, Artificial Sequence
  Synthetic polypeptide
EVQLLESGGGLVQPGGSLRLSCAASGFTFSTYAMSWVRQAPGKGLEWVSAISGSGGSTFYADSVKGRFTISRDNSKNTLSLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2096 - protein, 5 aa, Artificial Sequence
  Synthetic polypeptide
TYAMS

SEQ ID NO: 2097 - protein, 17 aa, Artificial Sequence
  Synthetic polypeptide
LISGSGGRTYYADSVKG

SEQ ID NO: 2098 - protein, 11 aa, Artificial Sequence
  Synthetic polypeptide
HDYSNYPYFDY

SEQ ID NO: 2099 - protein, 12 aa, Artificial Sequence
  Synthetic polypeptide
RASQGVRSDYLA

SEQ ID NO: 2100 - protein, 7 aa, Artificial Sequence
  Synthetic polypeptide
GASSRAT

SEQ ID NO: 2101 - protein, 9 aa, Artificial Sequence
  Synthetic polypeptide
QQYGSTPPT

SEQ ID NO: 2102 - protein, 120 aa, Artificial Sequence
  Synthetic polypeptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSS

SEQ ID NO: 2103 - protein, 108 aa, Artificial Sequence
  Synthetic polypeptide
EIVLTQSPGTLSLSPGERATLSCRASQGVRSDYLAWYQQKPGQALRLLIYGASSRATGIPDRFSGSGSGTDFTLTISRLEPEDFAVYHCQQYGSTPPTFGGGTKLEIK

SEQ ID NO: 2104 - protein, 243 aa, Artificial Sequence
  Synthetic polypeptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSDYLAWYQQKPGQALRLLIYGASSRATGIPDRFSGSGSGTDFTLTISRLEPEDFAVYHCQQYGSTPPTFGGGTKLEIK

SEQ ID NO: 2105 - protein, 498 aa, Artificial Sequence
  Synthetic polypeptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSDYLAWYQQKPGQALRLLIYGASSRATGIPDRFSGSGSGTDFTLTISRLEPEDFAVYHCQQYGSTPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2106 - protein, 5 aa, Artificial Sequence
  Synthetic polypeptide
TYAMS

SEQ ID NO: 2107 - protein, 17 aa, Artificial Sequence
  Synthetic polypeptide
AISGSGGRTFYADSVEG

SEQ ID NO: 2108 - protein, 11 aa, Artificial Sequence
  Synthetic polypeptide
HDYSNYPYFDY

SEQ ID NO: 2109 - protein, 12 aa, Artificial Sequence
  Synthetic polypeptide
RASQSVRSTYLA

SEQ ID NO: 2110 - protein, 7 aa, Artificial Sequence
  Synthetic polypeptide
GASSRAT

SEQ ID NO: 2111 - protein, 9 aa, Artificial Sequence
  Synthetic polypeptide
QQYGDLPFT

SEQ ID NO: 2112 - protein, 120 aa, Artificial Sequence
  Synthetic polypeptide
EVQLLESGGGMVQPGGSLRLSCAASGFTFSTYAMSWVRQAPGKGLEWVSAISGSGGRTFYADSVEGRFTISRDNSKNTLYLQMNSLRAEDTAVYYCAKHDYSNYPYFDYWGQGTLVTVSS

SEQ ID NO: 2113 - protein, 108 aa, Artificial Sequence
  Synthetic polypeptide
EIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIK

SEQ ID NO: 2114 - protein, 243 aa, Artificial Sequence
  Synthetic polypeptide
EVQLLESGGGMVQPGGSLRLSCAASGFTFSTYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIK

SEQ ID NO: 2115 - protein, 498 aa, Artificial Sequence
  Synthetic polypeptide
EVQLLESGGGMVQPGGSLRLSCAASGFTFSTYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2116 - protein, 5 aa, Artificial Sequence
  Synthetic polypeptide
SYAMS

SEQ ID NO: 2117 - protein, 17 aa, Artificial Sequence
  Synthetic polypeptide
AISGSGGYTYYADSVKG

SEQ ID NO: 2118 - protein, 11 aa, Artificial Sequence
  Synthetic polypeptide
HDYSNYPYFDY

SEQ ID NO: 2119 - protein, 12 aa, Artificial Sequence
  Synthetic polypeptide
RASQSVRSNYLA

SEQ ID NO: 2120 - protein, 7 aa, Artificial Sequence
  Synthetic polypeptide
GASSRAT

SEQ ID NO: 2121 - protein, 9 aa, Artificial Sequence
  Synthetic polypeptide
QQYGDLPFT

SEQ ID NO: 2122 - protein, 120 aa, Artificial Sequence
  Synthetic polypeptide
EVQLLESGGGLVQPGGSLRLSCAASGFTFSSYAMSWVRQAPGKGLEWVSAISGSGGYTYYADSVKGRFTISRDNSKNTLYLQMNSLRAEDTAVYYCAKHDYSNYPYFDYWGQGTLVTVSS

SEQ ID NO: 2123 - protein, 108 aa, Artificial Sequence
  Synthetic polypeptide
EIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK

SEQ ID NO: 2124 - protein, 243 aa, Artificial Sequence
  Synthetic polypeptide
EVQLLESGGGLVQPGGSLRLSCAASGFTFSSYAMSWVRQAPGKGLEWVSAISGSGGYTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK

SEQ ID NO: 2125 - protein, 498 aa, Artificial Sequence
  Synthetic polypeptide
EVQLLESGGGLVQPGGSLRLSCAASGFTFSSYAMSWVRQAPGKGLEWVSAISGSGGYTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2126 - protein, 5 aa, Artificial Sequence
  Synthetic polypeptide
VYAMS

SEQ ID NO: 2127 - protein, 17 aa, Artificial Sequence
  Synthetic polypeptide
TISDSGGSTFYADSVKG

SEQ ID NO: 2128 - protein, 11 aa, Artificial Sequence
  Synthetic polypeptide
HDYSNYAYFDY

SEQ ID NO: 2129 - protein, 12 aa, Artificial Sequence
  Synthetic polypeptide
RASQSVRSSYLA

SEQ ID NO: 2130 - protein, 7 aa, Artificial Sequence
  Synthetic polypeptide
GASSRAT

SEQ ID NO: 2131 - protein, 9 aa, Artificial Sequence
  Synthetic polypeptide
QQYGDLPFT

SEQ ID NO: 2132 - protein, 120 aa, Artificial Sequence
  Synthetic polypeptide
EVQLLESGGGLVQPGGSLRLSCAASGFTFSVYAMSWVRQAPGKGLEWVSTISDSGGSTFYADSVKGRFTISRDNSKNTLYLQMNRLRAEDTAVYYCARHDYSNYAYFDYWGQGTLVTVSS

SEQ ID NO: 2133 - protein, 108 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIK

SEQ ID NO: 2134 - protein, 243 aa, Artificial Sequence
  Synthetic polypeptide
EVQLLESGGGLVQPGGSLRLSCAASGFTFSVYAMSWVRQAPGKGLEWVSTISDSGGSTFYADSVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIK

SEQ ID NO: 2135 - protein, 498 aa, Artificial Sequence
  Synthetic polypeptide
EVQLLESGGGLVQPGGSLRLSCAASGFTFSVYAMSWVRQAPGKGLEWVSTISDSGGSTFYADSVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2136 - protein, 5 aa, Artificial Sequence
  Synthetic polypeptide
SYAMS

SEQ ID NO: 2137 - protein, 17 aa, Artificial Sequence
  Synthetic polypeptide
AISGSGGSTFYADSVKG

SEQ ID NO: 2138 - protein, 11 aa, Artificial Sequence
  Synthetic polypeptide
HDYSNYPYFDY

SEQ ID NO: 2139 - protein, 12 aa, Artificial Sequence
  Synthetic polypeptide
RASQSVRSSYLA

SEQ ID NO: 2140 - protein, 7 aa, Artificial Sequence
  Synthetic polypeptide
GASSRAT

SEQ ID NO: 2141 - protein, 9 aa, Artificial Sequence
  Synthetic polypeptide
QQYGDLPFT

SEQ ID NO: 2142 - protein, 120 aa, Artificial Sequence
  Synthetic polypeptide
EVQLLESGGGLAQPGGSLRLSCAASGFTFSSYAMSWVRQAPGKGLEWVSAISGSGGSTFYADSVKGRFTISRDNSKNTLYLQMNSLRAEDTAVYFCAKHDYSNYPYFDYWGQGTLVTVSS

SEQ ID NO: 2143 - protein, 108 aa, Artificial Sequence; identical to SEQ ID NO: 2133
  Synthetic polypeptide

SEQ ID NO: 2144 - protein, 243 aa, Artificial Sequence
  Synthetic polypeptide
EVQLLESGGGLAQPGGSLRLSCAASGFTFSSYAMSWVRQAPGKGLEWVSAISGSGGSTFYADSVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIK

SEQ ID NO: 2145 - protein, 498 aa, Artificial Sequence
  Synthetic polypeptide
EVQLLESGGGLAQPGGSLRLSCAASGFTFSSYAMSWVRQAPGKGLEWVSAISGSGGSTFYADSVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2146 - protein, 5 aa, Artificial Sequence
  Synthetic polypeptide
SYAMS

SEQ ID NO: 2147 - protein, 17 aa, Artificial Sequence
  Synthetic polypeptide
AISGSGGRTFYADSVEG

SEQ ID NO: 2148 - protein, 11 aa, Artificial Sequence
  Synthetic polypeptide
HDYSNYPYFDY

SEQ ID NO: 2149 - protein, 12 aa, Artificial Sequence
  Synthetic polypeptide
RASQSVRSNYLA

SEQ ID NO: 2150 - protein, 7 aa, Artificial Sequence
  Synthetic polypeptide
GASSRAT

SEQ ID NO: 2151 - protein, 9 aa, Artificial Sequence
  Synthetic polypeptide
QQYGDLPFT

SEQ ID NO: 2152 - protein, 120 aa, Artificial Sequence; identical to SEQ ID NO: 2062
  Synthetic polypeptide

SEQ ID NO: 2153 - protein, 108 aa, Artificial Sequence; identical to SEQ ID NO: 2123
  Synthetic polypeptide

SEQ ID NO: 2154 - protein, 243 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK

SEQ ID NO: 2155 - protein, 498 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2156 - protein, 5 aa, Artificial Sequence
  Synthetic polypeptide
SYAMS

SEQ ID NO: 2157 - protein, 17 aa, Artificial Sequence
  Synthetic polypeptide
AISGSGGRTFYADSVEG

SEQ ID NO: 2158 - protein, 11 aa, Artificial Sequence
  Synthetic polypeptide
HDYSNYPYFDY

SEQ ID NO: 2159 - protein, 12 aa, Artificial Sequence
  Synthetic polypeptide
RASQSVRSSYLA

SEQ ID NO: 2160 - protein, 7 aa, Artificial Sequence
  Synthetic polypeptide
GASSRAT

SEQ ID NO: 2161 - protein, 9 aa, Artificial Sequence
  Synthetic polypeptide
QQYGSSPFT

SEQ ID NO: 2162 - protein, 120 aa, Artificial Sequence; identical to SEQ ID NO: 2062
  Synthetic polypeptide

SEQ ID NO: 2163 - protein, 108 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIK

SEQ ID NO: 2164 - protein, 243 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIK

SEQ ID NO: 2165 - protein, 498 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2166 - protein, 5 aa, Artificial Sequence
  Synthetic polypeptide
TYAMS

SEQ ID NO: 2167 - protein, 17 aa, Artificial Sequence
  Synthetic polypeptide
AISGSGGGTFYADSVKG

SEQ ID NO: 2168 - protein, 11 aa, Artificial Sequence
  Synthetic polypeptide
HDYSNYPYFDY

SEQ ID NO: 2169 - protein, 12 aa, Artificial Sequence
  Synthetic polypeptide
RASQSIRSNYLA

SEQ ID NO: 2170 - protein, 7 aa, Artificial Sequence
  Synthetic polypeptide
GASSRAT

SEQ ID NO: 2171 - protein, 9 aa, Artificial Sequence
  Synthetic polypeptide
QQYGSSPFT

SEQ ID NO: 2172 - protein, 120 aa, Artificial Sequence
  Synthetic polypeptide
EVQLLESGGGLVQPGGSLRLSCAASGFTFSTYAMSWVRQAPGKGLEWVSAISGSGGGTFYADSVKGRFTISRDNSKNTLYLQMNSLRAEDTAVYYCAKHDYSNYPYFDYWGQGTLVTVSS

SEQ ID NO: 2173 - protein, 108 aa, Artificial Sequence
  Synthetic polypeptide
EIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIK

SEQ ID NO: 2174 - protein, 243 aa, Artificial Sequence
  Synthetic polypeptide
EVQLLESGGGLVQPGGSLRLSCAASGFTFSTYAMSWVRQAPGKGLEWVSAISGSGGGTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIK

SEQ ID NO: 2175 - protein, 498 aa, Artificial Sequence
  Synthetic polypeptide
EVQLLESGGGLVQPGGSLRLSCAASGFTFSTYAMSWVRQAPGKGLEWVSAISGSGGGTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2176 - protein, 5 aa, Artificial Sequence
  Synthetic polypeptide
TYAMS

SEQ ID NO: 2177 - protein, 17 aa, Artificial Sequence
  Synthetic polypeptide
LISGSGGRTYYADSVKG

SEQ ID NO: 2178 - protein, 11 aa, Artificial Sequence
  Synthetic polypeptide
HDYSNYPYFDY

SEQ ID NO: 2179 - protein, 12 aa, Artificial Sequence
  Synthetic polypeptide
RASQSVRSNYLA

SEQ ID NO: 2180 - protein, 7 aa, Artificial Sequence
  Synthetic polypeptide
GASNRAT

SEQ ID NO: 2181 - protein, 9 aa, Artificial Sequence
  Synthetic polypeptide
QQYGISPPT

SEQ ID NO: 2182 - protein, 120 aa, Artificial Sequence; identical to SEQ ID NO: 2102
  Synthetic polypeptide

SEQ ID NO: 2183 - protein, 108 aa, Artificial Sequence
  Synthetic polypeptide
EIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIK

SEQ ID NO: 2184 - protein, 243 aa, Artificial Sequence
  Synthetic polypeptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIK

SEQ ID NO: 2185 - protein, 498 aa, Artificial Sequence
  Synthetic polypeptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASNRATGIPDRFSGSGSGTDFTLTISRLEPEDFAVYSCQQYGISPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2186 - protein, 5 aa, Artificial Sequence
  Synthetic polypeptide
SYAMS

SEQ ID NO: 2187 - protein, 17 aa, Artificial Sequence
  Synthetic polypeptide
VISGSGGRTHYADSGKG

SEQ ID NO: 2188 - protein, 11 aa, Artificial Sequence
  Synthetic polypeptide
HDYSNYPYFDY

SEQ ID NO: 2189 - protein, 12 aa, Artificial Sequence
  Synthetic polypeptide
RASQSVRSSYLA

SEQ ID NO: 2190 - protein, 7 aa, Artificial Sequence
  Synthetic polypeptide
GASSRAT

SEQ ID NO: 2191 - protein, 9 aa, Artificial Sequence
  Synthetic polypeptide
EQYGNSPPT

SEQ ID NO: 2192 - protein, 120 aa, Artificial Sequence
  Synthetic polypeptide
EVQLLESGGGLVQPGGSLRLSCAASGFNFASYAMSWVRQAPGKGLEWVSVISGSGGRTHYADSGKGRFTISRDNSKNTLYLQMNSLRAEDTAVYYCAKHDYSNYPYFDYWGQGTLVTVSS

SEQ ID NO: 2193 - protein, 108 aa, Artificial Sequence
  Synthetic polypeptide
EIVLTQSPGTLSLSPGERATLSCRASQSVRSSYLAWYQQKPGQAPRLLIFGASSRATGIPDRFSGSESGTDFTLTINRLEPEDFAVYYCEQYGNSPPTFGGGTKVEIK

SEQ ID NO: 2194 - protein, 243 aa, Artificial Sequence
  Synthetic polypeptide
EVQLLESGGGLVQPGGSLRLSCAASGFNFASYAMSWVRQAPGKGLEWVSVISGSGGRTHYADSGKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIFGASSRATGIPDRFSGSESGTDFTLTINRLEPEDFAVYYCEQYGNSPPTFGGGTKVEIK

SEQ ID NO: 2195 - protein, 498 aa, Artificial Sequence
  Synthetic polypeptide
EVQLLESGGGLVQPGGSLRLSCAASGFNFASYAMSWVRQAPGKGLEWVSVISGSGGRTHYADSGKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIFGASSRATGIPDRFSGSESGTDFTLTINRLEPEDFAVYYCEQYGNSPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2196 - protein, 5 aa, Artificial Sequence
  Synthetic polypeptide
TYAMS

SEQ ID NO: 2197 - protein, 17 aa, Artificial Sequence
  Synthetic polypeptide
LISGSGGRTYYADSVKG

SEQ ID NO: 2198 - protein, 11 aa, Artificial Sequence
  Synthetic polypeptide
HDYSNYPYFDY

SEQ ID NO: 2199 - protein, 12 aa, Artificial Sequence
  Synthetic polypeptide
RASQSVRSSYLA

SEQ ID NO: 2200 - protein, 7 aa, Artificial Sequence
  Synthetic polypeptide
GASSRAT

SEQ ID NO: 2201 - protein, 9 aa, Artificial Sequence
  Synthetic polypeptide
QQYGSSPPP

SEQ ID NO: 2202 - protein, 120 aa, Artificial Sequence
  Synthetic polypeptide
EVQLLESGGGVVQPGRSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSS

SEQ ID NO: 2203 - protein, 108 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPPPFGGGTKVEIK

SEQ ID NO: 2204 - protein, 243 aa, Artificial Sequence
  Synthetic polypeptide
EVQLLESGGGVVQPGRSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPPPFGGGTKVEIK

SEQ ID NO: 2205 - protein, 498 aa, Artificial Sequence
  Synthetic polypeptide
EVQLLESGGGVVQPGRSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2206 - protein, 5 aa, Artificial Sequence
  Synthetic polypeptide
SYAMS

SEQ ID NO: 2207 - protein, 17 aa, Artificial Sequence
  Synthetic polypeptide
AISGSGGRAQYADSVQG

SEQ ID NO: 2208 - protein, 11 aa, Artificial Sequence
  Synthetic polypeptide
HDYSNYPYFDY

SEQ ID NO: 2209 - protein, 11 aa, Artificial Sequence
  Synthetic polypeptide
RASQSVSSNLA

SEQ ID NO: 2210 - protein, 7 aa, Artificial Sequence
  Synthetic polypeptide
GSSSRAT

SEQ ID NO: 2211 - protein, 9 aa, Artificial Sequence
  Synthetic polypeptide
QQYGSSPPP

SEQ ID NO: 2212 - protein, 120 aa, Artificial Sequence
  Synthetic polypeptide
EVQLLESGGGLVQPGGSLRLSCAASGFTFSSYAMSWVRQSPGKGLEWVSAISGSGGRAQYADSVQGRFTVSRDNSKNTLYLQMNSLRAEDTAVYYCAKHDYSNYPYFDYWGQGTLVTVSS

SEQ ID NO: 2213 - protein, 107 aa, Artificial Sequence
  Synthetic polypeptide
EIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIK

SEQ ID NO: 2214 - protein, 242 aa, Artificial Sequence
  Synthetic polypeptide
EVQLLESGGGLVQPGGSLRLSCAASGFTFSSYAMSWVRQSPGKGLEWVSAISGSGGRAQYADSVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIK

SEQ ID NO: 2215 - protein, 497 aa, Artificial Sequence
  Synthetic polypeptide
EVQLLESGGGLVQPGGSLRLSCAASGFTFSSYAMSWVRQSPGKGLEWVSAISGSGGRAQYADSVQGRFTVSRDNSKNTLYLQMNSLRAEDTAVYYCAKHDYSNYPYFDYWGQGTLVTVSSGGGGSGGGGSGGGGSEIVLTQSPATLSVSPGERATLSCRASQSVSSNLAWYQQKPGQAPRLLIYGSSSRATGIPDRFSGSGSGTDFTLTISRLEPEDFAVYYCQQYGSSPPPFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2216 - protein, 5 aa, Artificial Sequence
  Synthetic polypeptide
SYAMS

SEQ ID NO: 2217 - protein, 17 aa, Artificial Sequence
  Synthetic polypeptide
AISGSGGRTFYADSVEG

SEQ ID NO: 2218 - protein, 11 aa, Artificial Sequence
  Synthetic polypeptide
HDYSNYPYFDY

SEQ ID NO: 2219 - protein, 12 aa, Artificial Sequence
  Synthetic polypeptide
RASQGVRSDYLA

SEQ ID NO: 2220 - protein, 7 aa, Artificial Sequence
  Synthetic polypeptide
GASSRAT

SEQ ID NO: 2221 - protein, 9 aa, Artificial Sequence
  Synthetic polypeptide
QQYGSTPPT

SEQ ID NO: 2222 - protein, 120 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSS

SEQ ID NO: 2223 - protein, 108 aa, Artificial Sequence
  Synthetic polypeptide
EIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIK

SEQ ID NO: 2224 - protein, 243 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIK

SEQ ID NO: 2225 - protein, 498 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQGVRSDYLAWYQQKPGQAPRLLIYGASSRATGIPDRFSGSGSGTDFTLTISRLEPEDFAVYHCQQYGSTPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2226 - protein, 5 aa, Artificial Sequence
  Synthetic polypeptide
TYAMS

SEQ ID NO: 2227 - protein, 17 aa, Artificial Sequence
  Synthetic polypeptide
TISDSGGSTFYADSVMG

SEQ ID NO: 2228 - protein, 11 aa, Artificial Sequence
  Synthetic polypeptide
HDYSNYAFFDY

SEQ ID NO: 2229 - protein, 11 aa, Artificial Sequence
  Synthetic polypeptide
RASQSVSSNLA

SEQ ID NO: 2230 - protein, 7 aa, Artificial Sequence
  Synthetic polypeptide
GASSRAT

SEQ ID NO: 2231 - protein, 9 aa, Artificial Sequence
  Synthetic polypeptide
QQYYSTPFT

SEQ ID NO: 2232 - protein, 120 aa, Artificial Sequence
  Synthetic polypeptide
EVQLLESGGGLVQPGGSLRLSCAASGFTFSTYAMSWVRQAPGKGLEWVSTISDSGGSTFYADSVMGRFTISRDNSKNTLYLQMNSLRAEDTAVYYCARHDYSNYAFFDYWGQGTLVTVSS

SEQ ID NO: 2233 - protein, 107 aa, Artificial Sequence
  Synthetic polypeptide
EIVLTQSPATLSVSPGERATLSCRASQSVSSNLAWYQQKPGQAPRLLIYGASSRATGIPDRFSGSGSGTDFTLTISSLQAEDVAVYYCQQYYSTPFTFGPGTKVEIK

SEQ ID NO: 2234 - protein, 242 aa, Artificial Sequence
  Synthetic polypeptide
EVQLLESGGGLVQPGGSLRLSCAASGFTFSTYAMSWVRQAPGKGLEWVSTISDSGGSTFYADSVMGRFTISRDNSKNTLYLQMNSLRAEDTAVYYCARHDYSNYAFFDYWGQGTLVTVSSGGGGSGGGGSGGGGSEIVLTQSPATLSVSPGERATLSCRASQSVSSNLAWYQQKPGQAPRLLIYGASSRATGIPDRFSGSGSGTDFTLTISSLQAEDVAVYYCQQYYSTPFTFGPGTKVEIK

SEQ ID NO: 2235 - protein, 497 aa, Artificial Sequence
  Synthetic polypeptide
EVQLLESGGGLVQPGGSLRLSCAASGFTFSTYAMSWVRQAPGKGLEWVSTISDSGGSTFYADSVMGRFTISRDNSKNTLYLQMNSLRAEDTAVYYCARHDYSNYAFFDYWGQGTLVTVSSGGGGSGGGGSGGGGSEIVLTQSPATLSVSPGERATLSCRASQSVSSNLAWYQQKPGQAPRLLIYGASSRATGIPDRFSGSGSGTDFTLTISSLQAEDVAVYYCQQYYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2236 - protein, 5 aa, Artificial Sequence
  Synthetic polypeptide
TYAMS

SEQ ID NO: 2237 - protein, 17 aa, Artificial Sequence
  Synthetic polypeptide
TISDSGGSTFYADSVMG

SEQ ID NO: 2238 - protein, 11 aa, Artificial Sequence
  Synthetic polypeptide
HDYSNYAFFDY

SEQ ID NO: 2239 - protein, 11 aa, Artificial Sequence
  Synthetic polypeptide
RASQSVSSNLA

SEQ ID NO: 2240 - protein, 7 aa, Artificial Sequence
  Synthetic polypeptide
GASTRAT

SEQ ID NO: 2241 - protein, 9 aa, Artificial Sequence
  Synthetic polypeptide
QQYYSTPFT

SEQ ID NO: 2242 - protein, 120 aa, Artificial Sequence; identical to SEQ ID NO: 2232
  Synthetic polypeptide

SEQ ID NO: 2243 - protein, 107 aa, Artificial Sequence
  Synthetic polypeptide
EIVLTQSPATLSVSPGERATLSCRASQSVSSNLAWYQQKPGQAPRLLIYGASTRATGIPARFSGSGSGTEFTLAISRLEPEDFAVYYCQQYYSTPFTFGGGTKVEIK

SEQ ID NO: 2244 - protein, 242 aa, Artificial Sequence
  Synthetic polypeptide
EVQLLESGGGLVQPGGSLRLSCAASGFTFSTYAMSWVRQAPGKGLEWVSTISDSGGSTFYADSVMGRFTISRDNSKNTLYLQMNSLRAEDTAVYYCARHDYSNYAFFDYWGQGTLVTVSSGGGGSGGGGSGGGGSEIVLTQSPATLSVSPGERATLSCRASQSVSSNLAWYQQKPGQAPRLLIYGASTRATGIPARFSGSGSGTEFTLAISRLEPEDFAVYYCQQYYSTPFTFGGGTKVEIK

SEQ ID NO: 2245 - protein, 497 aa, Artificial Sequence
  Synthetic polypeptide
EVQLLESGGGLVQPGGSLRLSCAASGFTFSTYAMSWVRQAPGKGLEWVSTISDSGGSTFYADSVMGRFTISRDNSKNTLYLQMNSLRAEDTAVYYCARHDYSNYAFFDYWGQGTLVTVSSGGGGSGGGGSGGGGSEIVLTQSPATLSVSPGERATLSCRASQSVSSNLAWYQQKPGQAPRLLIYGASTRATGIPARFSGSGSGTEFTLAISRLEPEDFAVYYCQQYYSTPFTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2246 - protein, 5 aa, Artificial Sequence
  Synthetic polypeptide
TYAMS

SEQ ID NO: 2247 - protein, 17 aa, Artificial Sequence
  Synthetic polypeptide
AISGSGGYTYYADSVEG

SEQ ID NO: 2248 - protein, 11 aa, Artificial Sequence
  Synthetic polypeptide
HDYSNYAWFDP

SEQ ID NO: 2249 - protein, 12 aa, Artificial Sequence
  Synthetic polypeptide
RASQSVSSAYLA

SEQ ID NO: 2250 - protein, 7 aa, Artificial Sequence
  Synthetic polypeptide
GASSRAT

SEQ ID NO: 2251 - protein, 9 aa, Artificial Sequence
  Synthetic polypeptide
QQFGSSPFT

SEQ ID NO: 2252 - protein, 120 aa, Artificial Sequence
  Synthetic polypeptide
EVQLLESGGGLVQPGGSLRLSCAASGFTFSTYAMSWVRQAPGKGLDWVSAISGSGGYTYYADSVEGRFTISRDNSRNTLYLQMNSLRAEDTAVYYCASHDYSNYAWFDPWGQGTLVTVSS

SEQ ID NO: 2253 - protein, 108 aa, Artificial Sequence
  Synthetic polypeptide
EIVLTQSPGTLSLSPGERATLSCRASQSVSSAYLAWYQQKPGQAPRLLIYGASSRATGIPDRFSGSGSGTDFTLTISRLEPEDFAVYYCQQFGSSPFTFGPGTKVEIK

SEQ ID NO: 2254 - protein, 243 aa, Artificial Sequence
  Synthetic polypeptide
EVQLLESGGGLVQPGGSLRLSCAASGFTFSTYAMSWVRQAPGKGLDWVSAISGSGGYTYYADSVEGRFTISRDNSRNTLYLQMNSLRAEDTAVYYCASHDYSNYAWFDPWGQGTLVTVSSGGGGSGGGGSGGGGSEIVLTQSPGTLSLSPGERATLSCRASQSVSSAYLAWYQQKPGQAPRLLIYGASSRATGIPDRFSGSGSGTDFTLTISRLEPEDFAVYYCQQFGSSPFTFGPGTKVEIK

SEQ ID NO: 2255 - protein, 498 aa, Artificial Sequence
  Synthetic polypeptide
EVQLLESGGGLVQPGGSLRLSCAASGFTFSTYAMSWVRQAPGKGLDWVSAISGSGGYTYYADSVEGRFTISRDNSRNTLYLQMNSLRAEDTAVYYCASHDYSNYAWFDPWGQGTLVTVSSGGGGSGGGGSGGGGSEIVLTQSPGTLSLSPGERATLSCRASQSVSSAYLAWYQQKPGQAPRLLIYGASSRATGIPDRFSGSGSGTDFTLTISRLEPEDFAVYYCQQFGSSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2256 - protein, 5 aa, Artificial Sequence
  Synthetic polypeptide
SYAMS

SEQ ID NO: 2257 - protein, 17 aa, Artificial Sequence
  Synthetic polypeptide
AISGSGGRTYYADSVKG

SEQ ID NO: 2258 - protein, 11 aa, Artificial Sequence
  Synthetic polypeptide
HDYSNYPYFDY

SEQ ID NO: 2259 - protein, 12 aa, Artificial Sequence
  Synthetic polypeptide
RASQSVRGSYLA

SEQ ID NO: 2260 - protein, 7 aa, Artificial Sequence
  Synthetic polypeptide
SASSRAT

SEQ ID NO: 2261 - protein, 9 aa, Artificial Sequence
  Synthetic polypeptide
QQYGDSPFT

SEQ ID NO: 2262 - protein, 120 aa, Artificial Sequence
  Synthetic polypeptide
EVQLLESGGGLVQPGGSLRLSCAASGFTFSSYAMSWVRQAPGQGLEWVSAISGSGGRTYYADSVKGRFTISRDNSKNTLYLQMNSLRAEDTAVYYCAKHDYSNYPYFDYWGQGTLVTVSS

SEQ ID NO: 2263 - protein, 108 aa, Artificial Sequence
  Synthetic polypeptide
EIVLTQSPGTLSLSPGERATLSCRASQSVRGSYLAWYQQKPGQAPRLLIYSASSRATGIPDRFSGSGSGTDFTLTISRLEPEDFAVYYCQQYGDSPFTFGPGTKVEIK

SEQ ID NO: 2264 - protein, 243 aa, Artificial Sequence
  Synthetic polypeptide
EVQLLESGGGLVQPGGSLRLSCAASGFTFSSYAMSWVRQAPGQGLEWVSAISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRGSYLAWYQQKPGQAPRLLIYSASSRATGIPDRFSGSGSGTDFTLTISRLEPEDFAVYYCQQYGDSPFTFGPGTKVEIK

SEQ ID NO: 2265 - protein, 498 aa, Artificial Sequence
  Synthetic polypeptide
EVQLLESGGGLVQPGGSLRLSCAASGFTFSSYAMSWVRQAPGQGLEWVSAISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRGSYLAWYQQKPGQAPRLLIYSASSRATGIPDRFSGSGSGTDFTLTISRLEPEDFAVYYCQQYGDSPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2266 - protein, 5 aa, Artificial Sequence
  Synthetic polypeptide
SYAMS

SEQ ID NO: 2267 - protein, 17 aa, Artificial Sequence
  Synthetic polypeptide
AIGDGGGYTYYADSVKG

SEQ ID NO: 2268 - protein, 11 aa, Artificial Sequence
  Synthetic polypeptide
HDYSNYPYFDY

SEQ ID NO: 2269 - protein, 12 aa, Artificial Sequence
  Synthetic polypeptide
RASQGVRSSYFA

SEQ ID NO: 2270 - protein, 7 aa, Artificial Sequence
  Synthetic polypeptide
GASTRAT

SEQ ID NO: 2271 - protein, 9 aa, Artificial Sequence
  Synthetic polypeptide
QQYGSSPPT

SEQ ID NO: 2272 - protein, 120 aa, Artificial Sequence
  Synthetic polypeptide
EVQLLESGGGLVQPGGSLRLSCAASGFTFSSYAMSWVRQAPGKGLEWVSAIGDGGGYTYYADSVKGRFTISRDNSKNTLSLLMNSLRAEDTAVYYCARHDYSNYPYFDYWGQGTLVTVSS

SEQ ID NO: 2273 - protein, 108 aa, Artificial Sequence
  Synthetic polypeptide
EIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIK

SEQ ID NO: 2274 - protein, 243 aa, Artificial Sequence
  Synthetic polypeptide
EVQLLESGGGLVQPGGSLRLSCAASGFTFSSYAMSWVRQAPGKGLEWVSAIGDGGGYTYYADSVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIK

SEQ ID NO: 2275 - protein, 498 aa, Artificial Sequence
  Synthetic polypeptide
EVQLLESGGGLVQPGGSLRLSCAASGFTFSSYAMSWVRQAPGKGLEWVSAIGDGGGYTYYADSVKGRFTISRDNSKNTLSLLMNSLRAEDTAVYYCARHDYSNYPYFDYWGQGTLVTVSSGGGGSGGGGSGGGGSEIVLTQSPGTLSLSPGERATLSCRASQGVRSSYFAWYQQKPGQAPRLLIYGASTRATGIPARFSGSGSGTDFTLTISRLEPEDFAVYYCQQYGSSPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2276 - protein, 5 aa, Artificial Sequence
  Synthetic polypeptide
SYAMS

SEQ ID NO: 2277 - protein, 17 aa, Artificial Sequence
  Synthetic polypeptide
AISGSGGRTFYADSVEG

SEQ ID NO: 2278 - protein, 11 aa, Artificial Sequence
  Synthetic polypeptide
HDYSNYPYFDY

SEQ ID NO: 2279 - protein, 12 aa, Artificial Sequence
  Synthetic polypeptide
RASQSIRSNYLA

SEQ ID NO: 2280 - protein, 7 aa, Artificial Sequence
  Synthetic polypeptide
GASSRAT

SEQ ID NO: 2281 - protein, 9 aa, Artificial Sequence
  Synthetic polypeptide
QQYGSSPPS

SEQ ID NO: 2282 - protein, 120 aa, Artificial Sequence
  Synthetic polypeptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSS

SEQ ID NO: 2283 - protein, 108 aa, Artificial Sequence
  Synthetic polypeptide
EIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIK

SEQ ID NO: 2284 - protein, 243 aa, Artificial Sequence
  Synthetic polypeptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIK

SEQ ID NO: 2285 - protein, 498 aa, Artificial Sequence
  Synthetic polypeptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSNYLAWYQQKPGQAPRLLIYGASSRATGIPDRFSGSGSGTDFTLTISRLEPEDFAVYYCQQYGSSPPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2286 - protein, 5 aa, Artificial Sequence
  Synthetic polypeptide
SYAMS

SEQ ID NO: 2287 - protein, 17 aa, Artificial Sequence
  Synthetic polypeptide
AISGSGGGTFYADSVEG

SEQ ID NO: 2288 - protein, 11 aa, Artificial Sequence
  Synthetic polypeptide
HDYSNYPYFDY

SEQ ID NO: 2289 - protein, 12 aa, Artificial Sequence
  Synthetic polypeptide
RASQSVRSSYLA

SEQ ID NO: 2290 - protein, 7 aa, Artificial Sequence
  Synthetic polypeptide
GASSRAT

SEQ ID NO: 2291 - protein, 9 aa, Artificial Sequence
  Synthetic polypeptide
QQYGDLPFT

SEQ ID NO: 2292 - protein, 120 aa, Artificial Sequence
  Synthetic polypeptide
EVQLLESGGGVVQPGRSLRLSCAASGFTFSSYAMSWVRQAPGKGLEWVSAISGSGGGTFYADSVEGRFTISRDNSKNTLYLQMNSLRAEDTAVYYCARHDYSNYPYFDYWGLGTLVTVSS

SEQ ID NO: 2293 - protein, 108 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIK

SEQ ID NO: 2294 - protein, 243 aa, Artificial Sequence
  Synthetic polypeptide
EVQLLESGGGVVQPGRSLRLSCAASGFTFSSYAMSWVRQAPGKGLEWVSAISGSGGGTFYADSVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIK

SEQ ID NO: 2295 - protein, 498 aa, Artificial Sequence
  Synthetic polypeptide
EVQLLESGGGVVQPGRSLRLSCAASGFTFSSYAMSWVRQAPGKGLEWVSAISGSGGGTFYADSVEGRFTISRDNSKNTLYLQMNSLRAEDTAVYYCARHDYSNYPYFDYWGLGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYSCQQYGDLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2296 - protein, 5 aa, Artificial Sequence
  Synthetic polypeptide
SYAMS

SEQ ID NO: 2297 - protein, 17 aa, Artificial Sequence
  Synthetic polypeptide
AISGSGGRTFYADSVEG

SEQ ID NO: 2298 - protein, 11 aa, Artificial Sequence
  Synthetic polypeptide
HDYSNYPYFDY

SEQ ID NO: 2299 - protein, 12 aa, Artificial Sequence
  Synthetic polypeptide
RASQSIRSSYLA

SEQ ID NO: 2300 - protein, 7 aa, Artificial Sequence
  Synthetic polypeptide
GASSRAT

SEQ ID NO: 2301 - protein, 9 aa, Artificial Sequence
  Synthetic polypeptide
QQYGDLPFT

SEQ ID NO: 2302 - protein, 120 aa, Artificial Sequence; identical to SEQ ID NO: 2062
  Synthetic polypeptide

SEQ ID NO: 2303 - protein, 108 aa, Artificial Sequence
  Synthetic polypeptide
EIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKVDIK

SEQ ID NO: 2304 - protein, 243 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKVDIK

SEQ ID NO: 2305 - protein, 498 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2306 - protein, 5 aa, Artificial Sequence
  Synthetic polypeptide
SYAMS

SEQ ID NO: 2307 - protein, 17 aa, Artificial Sequence
  Synthetic polypeptide
AISGSGGRTFYADSVEG

SEQ ID NO: 2308 - protein, 11 aa, Artificial Sequence
  Synthetic polypeptide
HDYSNYPYFDY

SEQ ID NO: 2309 - protein, 12 aa, Artificial Sequence
  Synthetic polypeptide
RASQSVRSSYLA

SEQ ID NO: 2310 - protein, 7 aa, Artificial Sequence
  Synthetic polypeptide
GASSRAT

SEQ ID NO: 2311 - protein, 9 aa, Artificial Sequence
  Synthetic polypeptide
QQYGDLPFT

SEQ ID NO: 2312 - protein, 120 aa, Artificial Sequence; identical to SEQ ID NO: 2222
  Synthetic polypeptide

SEQ ID NO: 2313 - protein, 108 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIK

SEQ ID NO: 2314 - protein, 243 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIK

SEQ ID NO: 2315 - protein, 498 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCTKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2316 - protein, 5 aa, Artificial Sequence
  Synthetic polypeptide
TYAMS

SEQ ID NO: 2317 - protein, 17 aa, Artificial Sequence
  Synthetic polypeptide
LISGSGGRTYYADSVKG

SEQ ID NO: 2318 - protein, 11 aa, Artificial Sequence
  Synthetic polypeptide
HDYSNYPYFDY

SEQ ID NO: 2319 - protein, 12 aa, Artificial Sequence
  Synthetic polypeptide
RASQGVRSSYLA

SEQ ID NO: 2320 - protein, 7 aa, Artificial Sequence
  Synthetic polypeptide
GASSRAT

SEQ ID NO: 2321 - protein, 9 aa, Artificial Sequence
  Synthetic polypeptide
QQYGSSPPT

SEQ ID NO: 2322 - protein, 120 aa, Artificial Sequence; identical to SEQ ID NO: 2102
  Synthetic polypeptide

SEQ ID NO: 2323 - protein, 108 aa, Artificial Sequence
  Synthetic polypeptide
EIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIK

SEQ ID NO: 2324 - protein, 243 aa, Artificial Sequence
  Synthetic polypeptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIK

SEQ ID NO: 2325 - protein, 498 aa, Artificial Sequence
  Synthetic polypeptide
EVQLLESGGGLVQPGGSLRLSCAASGFTFSTYAMSWVRQAPGKGLEWVSLISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQGVRSSYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2326 - protein, 5 aa, Artificial Sequence
  Synthetic polypeptide
SYAMS

SEQ ID NO: 2327 - protein, 17 aa, Artificial Sequence
  Synthetic polypeptide
AISGSGGRTFYADSVEG

SEQ ID NO: 2328 - protein, 11 aa, Artificial Sequence
  Synthetic polypeptide
HDYSNYPYFDY

SEQ ID NO: 2329 - protein, 12 aa, Artificial Sequence
  Synthetic polypeptide
RASQSVRSNYLA

SEQ ID NO: 2330 - protein, 7 aa, Artificial Sequence
  Synthetic polypeptide
GASSRAT

SEQ ID NO: 2331 - protein, 9 aa, Artificial Sequence
  Synthetic polypeptide
QQYGSSPPT

SEQ ID NO: 2332 - protein, 120 aa, Artificial Sequence; identical to SEQ ID NO: 2282
  Synthetic polypeptide

SEQ ID NO: 2333 - protein, 108 aa, Artificial Sequence
  Synthetic polypeptide
EIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIK

SEQ ID NO: 2334 - protein, 243 aa, Artificial Sequence
  Synthetic polypeptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIK

SEQ ID NO: 2335 - protein, 498 aa, Artificial Sequence
  Synthetic polypeptide
EVQLLESGGGVVQPGRSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTINRLEPEDFAVYYCQQYGSSPPTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2336 - protein, 5 aa, Artificial Sequence
  Synthetic polypeptide
SYAMS

SEQ ID NO: 2337 - protein, 17 aa, Artificial Sequence
  Synthetic polypeptide
VISDSGGITDFADSVKG

SEQ ID NO: 2338 - protein, 11 aa, Artificial Sequence
  Synthetic polypeptide
HDYSNYFFFDY

SEQ ID NO: 2339 - protein, 11 aa, Artificial Sequence
  Synthetic polypeptide
RASQDISNYLN

SEQ ID NO: 2340 - protein, 7 aa, Artificial Sequence
  Synthetic polypeptide
AASSLQS

SEQ ID NO: 2341 - protein, 9 aa, Artificial Sequence
  Synthetic polypeptide
QQSYISPPT

SEQ ID NO: 2342 - protein, 120 aa, Artificial Sequence
  Synthetic polypeptide
EVQLLESGGGLVQPGGSLRLSCAASGFTFSSYAMSWVRQAPGKGLEWVSVISDSGGITDFADSVKGRFIISRDNSRNTLYLQMNSLRAEDTAVYFCARHDYSNYFFFDYWGQGTLVTVSS

SEQ ID NO: 2343 - protein, 107 aa, Artificial Sequence
  Synthetic polypeptide
DIQMTQSPSSLSASVGDRVTITCRASQDISNYLNWYQQKSGKAPELLIYAASSLQSGVPSRFSGSGSGTDFTLTISSLQPEDFATYYCQQSYISPPTFGQGTKVEIK

SEQ ID NO: 2344 - protein, 242 aa, Artificial Sequence
  Synthetic polypeptide
EVQLLESGGGLVQPGGSLRLSCAASGFTFSSYAMSWVRQAPGKGLEWVSVISDSGGITDFADSVKGRFIISRDNSRNTLYLQMNSLRAEDTAVYFCARHDYSNYFFFDYWGQGTLVTVSSGGGGSGGGGSGGGGSDIQMTQSPSSLSASVGDRVTITCRASQDISNYLNWYQQKSGKAPELLIYAASSLQSGVPSRFSGSGSGTDFTLTISSLQPEDFATYYCQQSYISPPTFGQGTKVEIK

SEQ ID NO: 2345 - protein, 497 aa, Artificial Sequence
  Synthetic polypeptide
EVQLLESGGGLVQPGGSLRLSCAASGFTFSSYAMSWVRQAPGKGLEWVSVISDSGGITDFADSVKGRFIISRDNSRNTLYLQMNSLRAEDTAVYFCARHDYSNYFFFDYWGQGTLVTVSSGGGGSGGGGSGGGGSDIQMTQSPSSLSASVGDRVTITCRASQDISNYLNWYQQKSGKAPELLIYAASSLQSGVPSRFSGSGSGTDFTLTISSLQPEDFATYYCQQSYISPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2346 - protein, 5 aa, Artificial Sequence
  Synthetic polypeptide
SYAMS

SEQ ID NO: 2347 - protein, 17 aa, Artificial Sequence
  Synthetic polypeptide
VISDSGGITDFADSVKG

SEQ ID NO: 2348 - protein, 11 aa, Artificial Sequence
  Synthetic polypeptide
HDYSNYFFFDY

SEQ ID NO: 2349 - protein, 11 aa, Artificial Sequence
  Synthetic polypeptide
RASQSISSYLN

SEQ ID NO: 2350 - protein, 7 aa, Artificial Sequence
  Synthetic polypeptide
AASSLQS

SEQ ID NO: 2351 - protein, 9 aa, Artificial Sequence
  Synthetic polypeptide
QQSYISPPT

SEQ ID NO: 2352 - protein, 120 aa, Artificial Sequence
  Synthetic polypeptide
EVQLLESGGGVVQPGRSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSS

SEQ ID NO: 2353 - protein, 107 aa, Artificial Sequence
  Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYISPPTFGQGTKVEIK

SEQ ID NO: 2354 - protein, 242 aa, Artificial Sequence
  Synthetic polypeptide
EVQLLESGGGVVQPGRSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYISPPTFGQGTKVEIK

SEQ ID NO: 2355 - protein, 497 aa, Artificial Sequence
  Synthetic polypeptide
EVQLLESGGGVVQPGRSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYISPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2356 - protein, 5 aa, Artificial Sequence
  Synthetic polypeptide
SYAMS

SEQ ID NO: 2357 - protein, 17 aa, Artificial Sequence
  Synthetic polypeptide
VISGSGGRTDYADSVKG

SEQ ID NO: 2358 - protein, 11 aa, Artificial Sequence
  Synthetic polypeptide
HDYSNRFYFDY

SEQ ID NO: 2359 - protein, 11 aa, Artificial Sequence
  Synthetic polypeptide
RASQSISSYLN

SEQ ID NO: 2360 - protein, 7 aa, Artificial Sequence
  Synthetic polypeptide
AASSLQS

SEQ ID NO: 2361 - protein, 9 aa, Artificial Sequence
  Synthetic polypeptide
QQSYSAPPT

SEQ ID NO: 2362 - protein, 120 aa, Artificial Sequence
  Synthetic polypeptide
EVQLLESGGGLVQPGGSLRLSCAASGFTFSSYAMSWVRQVPGKGLEWVSVISGSGGRTDYADSVKGRFTISRDNSKNTLYLQMNSLRAEDTAVYYCARHDYSNRFYFDYWGQGTLVTVSS

SEQ ID NO: 2363 - protein, 107 aa, Artificial Sequence
  Synthetic polypeptide
DIQMTQSPSSLSASVGDRVSITCRASQSISSYLNWYQQKPGKAPKLLIYAASSLQSGVPSRFSGSGSGTDFTLTISSLQPEDFATYYCQQSYSAPPTFGGGTKVEIK

SEQ ID NO: 2364 - protein, 242 aa, Artificial Sequence
  Synthetic polypeptide
EVQLLESGGGLVQPGGSLRLSCAASGFTFSSYAMSWVRQVPGKGLEWVSVISGSGGRTDYADSVKGRFTISRDNSKNTLYLQMNSLRAEDTAVYYCARHDYSNRFYFDYWGQGTLVTVSSGGGGSGGGGSGGGGSDIQMTQSPSSLSASVGDRVSITCRASQSISSYLNWYQQKPGKAPKLLIYAASSLQSGVPSRFSGSGSGTDFTLTISSLQPEDFATYYCQQSYSAPPTFGGGTKVEIK

SEQ ID NO: 2365 - protein, 497 aa, Artificial Sequence
  Synthetic polypeptide
EVQLLESGGGLVQPGGSLRLSCAASGFTFSSYAMSWVRQVPGKGLEWVSVISGSGGRTDYADSVKGRFTISRDNSKNTLYLQMNSLRAEDTAVYYCARHDYSNRFYFDYWGQGTLVTVSSGGGGSGGGGSGGGGSDIQMTQSPSSLSASVGDRVSITCRASQSISSYLNWYQQKPGKAPKLLIYAASSLQSGVPSRFSGSGSGTDFTLTISSLQPEDFATYYCQQSYSAPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2366 - protein, 5 aa, Artificial Sequence
  Synthetic polypeptide
SYAMS

SEQ ID NO: 2367 - protein, 17 aa, Artificial Sequence
  Synthetic polypeptide
VISDSGGITDYADSVKG

SEQ ID NO: 2368 - protein, 11 aa, Artificial Sequence
  Synthetic polypeptide
HDYSNRYYFDY

SEQ ID NO: 2369 - protein, 11 aa, Artificial Sequence
  Synthetic polypeptide
RASQSISSYLN

SEQ ID NO: 2370 - protein, 7 aa, Artificial Sequence
  Synthetic polypeptide
AASSLQS

SEQ ID NO: 2371 - protein, 9 aa, Artificial Sequence
  Synthetic polypeptide
QQSYSTPLT

SEQ ID NO: 2372 - protein, 120 aa, Artificial Sequence
  Synthetic polypeptide
EVQLLESGGGLVQPGGSLRLSCAASGFTFSSYAMSWVRQAPGKGLEWVSVISDSGGITDYADSVKGRFTISRDNSKNTLYLQMNSLRAEDRAVYYCARHDYSNRYYFDYWGQGTLVTVSS

SEQ ID NO: 2373 - protein, 107 aa, Artificial Sequence [sequence omitted]

SEQ ID NO: 2374 - protein, 242 aa, Artificial Sequence
  Synthetic polypeptide
EVQLLESGGGLVQPGGSLRLSCAASGFTFSSYAMSWVRQAPGKGLEWVSVISDSGGITDYADSVKGRFTISRDNSKNTLYLQMNSLRAEDRAVYYCARHDYSNRYYFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 2375 - protein, 497 aa, Artificial Sequence
  Synthetic polypeptide
EVQLLESGGGLVQPGGSLRLSCAASGFTFSSYAMSWVRQAPGKGLEWVSVISDSGGITDYADSVKGRFTISRDNSKNTLYLQMNSLRAEDRAVYYCARHDYSNRYYFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2376 - protein, 5 aa, Artificial Sequence
  Synthetic polypeptide
SYAMS

SEQ ID NO: 2377 - protein, 17 aa, Artificial Sequence
  Synthetic polypeptide
VISDSGGITDFADSVKG

SEQ ID NO: 2378 - protein, 11 aa, Artificial Sequence
  Synthetic polypeptide
HDYSNYFFFDY

SEQ ID NO: 2379 - protein, 11 aa, Artificial Sequence
  Synthetic polypeptide
RASQGISNYLA

SEQ ID NO: 2380 - protein, 7 aa, Artificial Sequence
  Synthetic polypeptide
AASILQS

SEQ ID NO: 2381 - protein, 9 aa, Artificial Sequence
  Synthetic polypeptide
QQYFAYPIT

SEQ ID NO: 2382 - protein, 120 aa, Artificial Sequence
  Synthetic polypeptide
EVQLLESGGGLVQPGGSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSS

SEQ ID NO: 2383 - protein, 107 aa, Artificial Sequence
  Synthetic polypeptide
DIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIK

SEQ ID NO: 2384 - protein, 242 aa, Artificial Sequence
  Synthetic polypeptide
EVQLLESGGGLVQPGGSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIK

SEQ ID NO: 2385 - protein, 497 aa, Artificial Sequence
  Synthetic polypeptide
EVQLLESGGGLVQPGGSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2386 - protein, 5 aa, Artificial Sequence
  Synthetic polypeptide
SYAMS

SEQ ID NO: 2387 - protein, 17 aa, Artificial Sequence
  Synthetic polypeptide
VISDSGGITDFADSVKG

SEQ ID NO: 2388 - protein, 11 aa, Artificial Sequence
  Synthetic polypeptide
HDYSNYFFFDY

SEQ ID NO: 2389 - protein, 11 aa, Artificial Sequence
  Synthetic polypeptide
RASQSISSYLN

SEQ ID NO: 2390 - protein, 7 aa, Artificial Sequence
  Synthetic polypeptide
AASSLQS

SEQ ID NO: 2391 - protein, 9 aa, Artificial Sequence
  Synthetic polypeptide
QQSYSTPIT

SEQ ID NO: 2392 - protein, 120 aa, Artificial Sequence
  Synthetic polypeptide
EVQLLESGGGLVQPGGSLRLSCAASGFTFSSYAMSWVRQAPGKGLEWVSVISDSGGITDFADSVKGRSTISRDNSRNTLYLQMNSLRAEDTAVYFCARHDYSNYFFFDYWGQGTLVTVSS

SEQ ID NO: 2393 - protein, 107 aa, Artificial Sequence
  Synthetic polypeptide
DIQMTQSPSSVSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 2394 - protein, 242 aa, Artificial Sequence
  Synthetic polypeptide
EVQLLESGGGLVQPGGSLRLSCAASGFTFSSYAMSWVRQAPGKGLEWVSVISDSGGITDFADSVKGRSTISRDNSRNTLYLQMNSLRAEDTAVYFCARHDYSNYFFFDYWGQGTLVTVSSGGGGSGGGGSGGGGSDIQMTQSPSSVSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 2395 - protein, 497 aa, Artificial Sequence
  Synthetic polypeptide
EVQLLESGGGLVQPGGSLRLSCAASGFTFSSYAMSWVRQAPGKGLEWVSVISDSGGITDFADSVKGRSTISRDNSRNTLYLQMNSLRAEDTAVYFCARHDYSNYFFFDYWGQGTLVTVSSGGGGSGGGGSGGGGSDIQMTQSPSSVSASVGDRVTITCRASQSISSYLNWYQQKPGKAPKLLIYAASSLQSGVPSRFSGSGSGTDFTLTISSLQPEDFATYYCQQSYSTPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2396 - protein, 5 aa, Artificial Sequence
  Synthetic polypeptide
TYAMS

SEQ ID NO: 2397 - protein, 17 aa, Artificial Sequence
  Synthetic polypeptide
AISGSGGYTYYADSVEG

SEQ ID NO: 2398 - protein, 11 aa, Artificial Sequence
  Synthetic polypeptide
HDYSNYAWFDP

SEQ ID NO: 2399 - protein, 11 aa, Artificial Sequence
  Synthetic polypeptide
RASQSISSYLN

SEQ ID NO: 2400 - protein, 7 aa, Artificial Sequence
  Synthetic polypeptide
AASSLQS

SEQ ID NO: 2401 - protein, 9 aa, Artificial Sequence
  Synthetic polypeptide
QQSYSTPFT

SEQ ID NO: 2402 - protein, 120 aa, Artificial Sequence; identical to SEQ ID NO: 2252
  Synthetic polypeptide

SEQ ID NO: 2403 - protein, 107 aa, Artificial Sequence
  Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTRLEIK

SEQ ID NO: 2404 - protein, 242 aa, Artificial Sequence
  Synthetic polypeptide
EVQLLESGGGLVQPGGSLRLSCAASGFTFSTYAMSWVRQAPGKGLDWVSAISGSGGYTYYADSVEGRFTISRDNSRNTLYLQMNSLRAEDTAVYYCASHDYSNYAWFDPWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTRLEIK

SEQ ID NO: 2405 - protein, 497 aa, Artificial Sequence
  Synthetic polypeptide
EVQLLESGGGLVQPGGSLRLSCAASGFTFSTYAMSWVRQAPGKGLDWVSAISGSGGYTYYADSVEGRFTISRDNSRNTLYLQMNSLRAEDTAVYYCASHDYSNYAWFDPWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2406 - protein, 7 aa, Artificial Sequence
  Synthetic polypeptide
TDGYYWS

SEQ ID NO: 2407 - protein, 16 aa, Artificial Sequence
  Synthetic polypeptide
YIYYSGSTNYNPSLKS

SEQ ID NO: 2408 - protein, 8 aa, Artificial Sequence
  Synthetic polypeptide
GIGLGFEY

SEQ ID NO: 2409 - protein, 11 aa, Artificial Sequence
  Synthetic polypeptide
GGNNIGSKSVH

SEQ ID NO: 2410 - protein, 7 aa, Artificial Sequence
  Synthetic polypeptide
DDSDRPS

SEQ ID NO: 2411 - protein, 12 aa, Artificial Sequence
  Synthetic polypeptide
QVWDRSSDQDVV

SEQ ID NO: 2412 - protein, 118 aa, Artificial Sequence
  Synthetic polypeptide
QVQLQESGPGLVKPSETLSLTCTVSGGSVSTDGYYWSWIRQPPGKGLEWIGYIYYSGSTNYNPSLKSRVTISVDTSKNQFSLKLSSVTAADTAVYYCARGIGLGFEYWGQGTLVTVSS

SEQ ID NO: 2413 - protein, 109 aa, Artificial Sequence
  Synthetic polypeptide
SYVLTQLTSVSVAPGQTARITCGGNNIGSKSVHWYQQKPGQAPVLVVYDDSDRPSGIPERFSGSNSGNTATLTISRVEAGDEADFYCQVWDRSSDQDVVFGGGTKLTVL

SEQ ID NO: 2414 - protein, 242 aa, Artificial Sequence
  Synthetic polypeptide
QVQLQESGPGLVKPSETLSLTCTVSGGSVSTDGYYWSWIRQPPGKGLEWIGYIYYSGSTNYNPSLKSRVTISVDTSKNQFSLKLSSVTAADTAVYYCARGIGLGFEYWGQGTLVTVSSGGGGSGGGGSGGGGSSYVLTQLTSVSVAPGQTARITCGGNNIGSKSVHWYQQKPGQAPVLVVYDDSDRPSGIPERFSGSNSGNTATLTISRVEAGDEADFYCQVWDRSSDQDVVFGGGTKLTVL

SEQ ID NO: 2415 - protein, 497 aa, Artificial Sequence
  Synthetic polypeptide
QVQLQESGPGLVKPSETLSLTCTVSGGSVSTDGYYWSWIRQPPGKGLEWIGYIYYSGSTNYNPSLKSRVTISVDTSKNQFSLKLSSVTAADTAVYYCARGIGLGFEYWGQGTLVTVSSGGGGSGGGGSGGGGSSYVLTQLTSVSVAPGQTARITCGGNNIGSKSVHWYQQKPGQAPVLVVYDDSDRPSGIPERFSGSNSGNTATLTISRVEAGDEADFYCQVWDRSSDQDVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2416 - protein, 7 aa, Artificial Sequence
  Synthetic polypeptide
TDGYYWS

SEQ ID NO: 2417 - protein, 16 aa, Artificial Sequence
  Synthetic polypeptide
YIYYSGSTNYNPSLKS

SEQ ID NO: 2418 - protein, 8 aa, Artificial Sequence
  Synthetic polypeptide
GIGLGFEY

SEQ ID NO: 2419 - protein, 11 aa, Artificial Sequence
  Synthetic polypeptide
GGNNIGSKSVH

SEQ ID NO: 2420 - protein, 7 aa, Artificial Sequence
  Synthetic polypeptide
DDSDRPS

SEQ ID NO: 2421 - protein, 12 aa, Artificial Sequence
  Synthetic polypeptide
QVWDRSSDQDVV

SEQ ID NO: 2422 - protein, 118 aa, Artificial Sequence; identical to SEQ ID NO: 2412
  Synthetic polypeptide

SEQ ID NO: 2423 - protein, 109 aa, Artificial Sequence
  Synthetic polypeptide
SYVLTQLSSVSVAPGQTARITCGGNNIGSKSVHWYQQKPGQAPVLVVYDDSDRPSGIPERFSGSNSGNTATLTISRVEAGDEADYYCQVWDRSSDQDVVFGGGTKLTVL

SEQ ID NO: 2424 - protein, 242 aa, Artificial Sequence
  Synthetic polypeptide
QVQLQESGPGLVKPSETLSLTCTVSGGSVSTDGYYWSWIRQPPGKGLEWIGYIYYSGSTNYNPSLKSRVTISVDTSKNQFSLKLSSVTAADTAVYYCARGIGLGFEYWGQGTLVTVSSGGGGSGGGGSGGGGSSYVLTQLSSVSVAPGQTARITCGGNNIGSKSVHWYQQKPGQAPVLVVYDDSDRPSGIPERFSGSNSGNTATLTISRVEAGDEADYYCQVWDRSSDQDVVFGGGTKLTVL

SEQ ID NO: 2425 - protein, 497 aa, Artificial Sequence
  Synthetic polypeptide
QVQLQESGPGLVKPSETLSLTCTVSGGSVSTDGYYWSWIRQPPGKGLEWIGYIYYSGSTNYNPSLKSRVTISVDTSKNQFSLKLSSVTAADTAVYYCARGIGLGFEYWGQGTLVTVSSGGGGSGGGGSGGGGSSYVLTQLSSVSVAPGQTARITCGGNNIGSKSVHWYQQKPGQAPVLVVYDDSDRPSGIPERFSGSNSGNTATLTISRVEAGDEADYYCQVWDRSSDQDVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2426 - protein, 5 aa, Artificial Sequence
  Synthetic polypeptide
SYAMS

SEQ ID NO: 2427 - protein, 17 aa, Artificial Sequence
  Synthetic polypeptide
AISGSGGRTFYADSVEG

SEQ ID NO: 2428 - protein, 11 aa, Artificial Sequence
  Synthetic polypeptide
HDYSNYPYFDY

SEQ ID NO: 2429 - protein, 12 aa, Artificial Sequence
  Synthetic polypeptide
RASQSVRSSYLA

SEQ ID NO: 2430 - protein, 7 aa, Artificial Sequence
  Synthetic polypeptide
GASSRAT

SEQ ID NO: 2431 - protein, 9 aa, Artificial Sequence
  Synthetic polypeptide
QQYGSSPPT

SEQ ID NO: 2432 - protein, 120 aa, Artificial Sequence; identical to SEQ ID NO: 2062
  Synthetic polypeptide

SEQ ID NO: 2433 - protein, 108 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIK

SEQ ID NO: 2434 - protein, 243 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIK

SEQ ID NO: 2435 - protein, 498 aa, Artificial Sequence
  Synthetic polypeptide
EVQLLESGGGMVQPGGSLRLSCAASGFTFSSYAMSWVRQAPGKGLEWVSAISGSGGRTFYADSVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYFCQQYGSSPPTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2436 - protein, 5 aa, Artificial Sequence
  Synthetic polypeptide
IYAMS

SEQ ID NO: 2437 - protein, 17 aa, Artificial Sequence
  Synthetic polypeptide
AIGDSGGSTFYADSVKG

SEQ ID NO: 2438 - protein, 11 aa, Artificial Sequence
  Synthetic polypeptide
HDYSNYPYFDY

SEQ ID NO: 2439 - protein, 12 aa, Artificial Sequence
  Synthetic polypeptide
RASQSVRSSYVA

SEQ ID NO: 2440 - protein, 7 aa, Artificial Sequence
  Synthetic polypeptide
GASSRAT

SEQ ID NO: 2441 - protein, 9 aa, Artificial Sequence
  Synthetic polypeptide
QQYGDLPFT

SEQ ID NO: 2442 - protein, 120 aa, Artificial Sequence
  Synthetic polypeptide
EVQLLESGGGLVQPGGSLRLSCAASGFTFSIYAMSWVRQAPGKGLEWVSAIGDSGGSTFYADSVKGRFTISRDNSKNTLYLQMNSLRAEDTAVYYCAKHDYSNYPYFDYWGQGTLVTVSS

SEQ ID NO: 2443 - protein, 108 aa, Artificial Sequence
  Synthetic polypeptide
EIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIK

SEQ ID NO: 2444 - protein, 243 aa, Artificial Sequence
  Synthetic polypeptide
EVQLLESGGGLVQPGGSLRLSCAASGFTFSIYAMSWVRQAPGKGLEWVSAIGDSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIK

SEQ ID NO: 2445 - protein, 498 aa, Artificial Sequence
  Synthetic polypeptide
EVQLLESGGGLVQPGGSLRLSCAASGFTFSIYAMSWVRQAPGKGLEWVSAIGDSGGSTFYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSSYVAWYQQKPGQAPRLLIYGASSRATGIPDRFSGSGSGTDFTLTISRLEPEDFAVYYCQQYGDLPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2446 - protein, 5 aa, Artificial Sequence
  Synthetic polypeptide
SYGMH

SEQ ID NO: 2447 - protein, 17 aa, Artificial Sequence
  Synthetic polypeptide
VISYDGSNKYYADSVKG

SEQ ID NO: 2448 - protein, 15 aa, Artificial Sequence
  Synthetic polypeptide
GRYYGSGNYNHGMDV

SEQ ID NO: 2449 - protein, 11 aa, Artificial Sequence
  Synthetic polypeptide
RASQSISSYLN

SEQ ID NO: 2450 - protein, 7 aa, Artificial Sequence
  Synthetic polypeptide
AASSLQS

SEQ ID NO: 2451 - protein, 9 aa, Artificial Sequence
  Synthetic polypeptide
QQSYSTPFT

SEQ ID NO: 2452 - protein, 124 aa, Artificial Sequence
  Synthetic polypeptide
QVQLVESGGGVVQPGRSLRLSCAASGFMFSSYGMHWVRQAPGKGLEWVAVISYDGSNKYYADSVKGRFTISRDNSKNTLYLQMNSLRAEDTAVYYCARGRYYGSGNYNHGMDVWGQGTTVTVSS

SEQ ID NO: 2453 - protein, 107 aa, Artificial Sequence
  Synthetic polypeptide
DIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIK

SEQ ID NO: 2454 - protein, 246 aa, Artificial Sequence
  Synthetic polypeptide
QVQLVESGGGVVQPGRSLRLSCAASGFMFSSYGMHWVRQAPGKGLEWVAVISYDGSNKYYADSVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIK

SEQ ID NO: 2455 - protein, 501 aa, Artificial Sequence
  Synthetic polypeptide
QVQLVESGGGVVQPGRSLRLSCAASGFMFSSYGMHWVRQAPGKGLEWVAVISYDGSNKYYADSVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2456 - protein, 5 aa, Artificial Sequence
  Synthetic polypeptide
SYGMH

SEQ ID NO: 2457 - protein, 17 aa, Artificial Sequence
  Synthetic polypeptide
VISYDGSNKYYADSVKG

SEQ ID NO: 2458 - protein, 15 aa, Artificial Sequence
  Synthetic polypeptide
GRYYGSGSYNYGMDV

SEQ ID NO: 2459 - protein, 11 aa, Artificial Sequence
  Synthetic polypeptide
RASQSIFDYLN

SEQ ID NO: 2460 - protein, 7 aa, Artificial Sequence
  Synthetic polypeptide
AASSLQS

SEQ ID NO: 2461 - protein, 9 aa, Artificial Sequence
  Synthetic polypeptide
QQSYSTPLT

SEQ ID NO: 2462 - protein, 124 aa, Artificial Sequence
  Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYYGSGSYNYGMDVWGQGTTVTVSS

SEQ ID NO: 2463 - protein, 107 aa, Artificial Sequence
  Synthetic polypeptide
DIQMTQSPSSLSASVGDRVTITCRASQSIFDYLNWYQQKPGKAPKLLIYAASSLQSGVPSRFSGSGFGTDFTLTISSLQPEDFATYYCQQSYSTPLTFGGGTKLEIK

SEQ ID NO: 2464 - protein, 246 aa, Artificial Sequence
  Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYYGSGSYNYGMDVWGQGTTVTVSSGGGGSGGGGSGGGGSDIQMTQSPSSLSASVGDRVTITCRASQSIFDYLNWYQQKPGKAPKLLIYAASSLQSGVPSRFSGSGFGTDFTLTISSLQPEDFATYYCQQSYSTPLTFGGGTKLEIK

SEQ ID NO: 2465 - protein, 501 aa, Artificial Sequence
  Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGRYYGSGSYNYGMDVWGQGTTVTVSSGGGGSGGGGSGGGGSDIQMTQSPSSLSASVGDRVTITCRASQSIFDYLNWYQQKPGKAPKLLIYAASSLQSGVPSRFSGSGFGTDFTLTISSLQPEDFATYYCQQSYSTPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2466 - protein, 5 aa, Artificial Sequence
  Synthetic polypeptide
SYGMH

SEQ ID NO: 2467 - protein, 17 aa, Artificial Sequence
  Synthetic polypeptide
VIWYDGSSEYYADSVKG

SEQ ID NO: 2468 - protein, 11 aa, Artificial Sequence
  Synthetic polypeptide
DNSYNYYGMDV

SEQ ID NO: 2469 - protein, 14 aa, Artificial Sequence
  Synthetic polypeptide
TGSSSNIGAAYDVH

SEQ ID NO: 2470 - protein, 7 aa, Artificial Sequence
  Synthetic polypeptide
VNSHRPP

SEQ ID NO: 2471 - protein, 11 aa, Artificial Sequence
  Synthetic polypeptide
LSYDNSLSGSV

SEQ ID NO: 2472 - protein, 120 aa, Artificial Sequence
  Synthetic polypeptide
QVQLVESGGGVVQPGRSLRLSCAASGFTFSSYGMHWVRQAPGKGLEWVAVIWYDGSSEYYADSVKGRFTISRDNSKNTLYLQMNSLRAEDTAVYYCARDNSYNYYGMDVWGQGTTVTVSS

SEQ ID NO: 2473 - protein, 111 aa, Artificial Sequence
  Synthetic polypeptide
QSVLTQPPSVSGAPGQRVTISCTGSSSNIGAAYDVHWYQQFPGTAPKLLIYVNSHRPPGVPDRFSGSKSGTSASLAITGLQAEDEADYYCLSYDNSLSGSVFGGGTKLTVL

SEQ ID NO: 2474 - protein, 246 aa, Artificial Sequence
  Synthetic polypeptide
QVQLVESGGGVVQPGRSLRLSCAASGFTFSSYGMHWVRQAPGKGLEWVAVIWYDGSSEYYADSVKGRFTISRDNSKNTLYLQMNSLRAEDTAVYYCARDNSYNYYGMDVWGQGTTVTVSSGGGGSGGGGSGGGGSQSVLTQPPSVSGAPGQRVTISCTGSSSNIGAAYDVHWYQQFPGTAPKLLIYVNSHRPPGVPDRFSGSKSGTSASLAITGLQAEDEADYYCLSYDNSLSGSVFGGGTKLTVL

SEQ ID NO: 2475 - protein, 501 aa, Artificial Sequence
  Synthetic polypeptide
QVQLVESGGGVVQPGRSLRLSCAASGFTFSSYGMHWVRQAPGKGLEWVAVIWYDGSSEYYADSVKGRFTISRDNSKNTLYLQMNSLRAEDTAVYYCARDNSYNYYGMDVWGQGTTVTVSSGGGGSGGGGSGGGGSQSVLTQPPSVSGAPGQRVTISCTGSSSNIGAAYDVHWYQQFPGTAPKLLIYVNSHRPPGVPDRFSGSKSGTSASLAITGLQAEDEADYYCLSYDNSLSGSVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2476 - protein, 7 aa, Artificial Sequence
  Synthetic polypeptide
SSSYYWG

SEQ ID NO: 2477 - protein, 16 aa, Artificial Sequence
  Synthetic polypeptide
SIYHSGGTYFNPSLKS

SEQ ID NO: 2478 - protein, 15 aa, Artificial Sequence
  Synthetic polypeptide
HYEILTGYYPDVFDI

SEQ ID NO: 2479 - protein, 11 aa, Artificial Sequence
  Synthetic polypeptide
RASQSISSYLN

SEQ ID NO: 2480 - protein, 7 aa, Artificial Sequence
  Synthetic polypeptide
AASNLQS

SEQ ID NO: 2481 - protein, 9 aa, Artificial Sequence
  Synthetic polypeptide
QQSFSSPRT

SEQ ID NO: 2482 - protein, 125 aa, Artificial Sequence
  Synthetic polypeptide
QVQLQESGPGLVKPSQTLSLTCTVSGGSISSSSYYWGWIRQPPGKGLEWIGSIYHSGGTYFNPSLKSRVTISVDTSKNQFSLKLSSVTAADTAVYYCARHYEILTGYYPDVFDIWGQGTMVTVSS

SEQ ID NO: 2483 - protein, 107 aa, Artificial Sequence
  Synthetic polypeptide
DIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGQGTKVEIK

SEQ ID NO: 2484 - protein, 247 aa, Artificial Sequence
  Synthetic polypeptide
QVQLQESGPGLVKPSQTLSLTCTVSGGSISSSSYYWGWIRQPPGKGLEWIGSIYHSGGTYFNPSLKSRVTISVDTSKNQFSLKLSSVTAADTAVYYCARHYEILTGYYPDVFDIWGQGTMVTVSSGGGGSGGGGSGGGGSDIQMTQSPSSLSASVGDRVTITCRASQSISSYLNWYQQKPGKAPKLLIYAASNLQSGVSSRFSGSGSGTDFTLTISSLQPEDFATYYCQQSFSSPRTFGQGTKVEIK

SEQ ID NO: 2485 - protein, 502 aa, Artificial Sequence [sequence omitted]

SEQ ID NO: 2486 - protein, 5 aa, Artificial Sequence
  Synthetic polypeptide
GFYWS

SEQ ID NO: 2487 - protein, 16 aa, Artificial Sequence
  Synthetic polypeptide
EIDHSGSTNYNPSLKS

SEQ ID NO: 2488 - protein, 10 aa, Artificial Sequence
  Synthetic polypeptide
NGYSGYLFDY

SEQ ID NO: 2489 - protein, 11 aa, Artificial Sequence
  Synthetic polypeptide
RASQIISSYLN

SEQ ID NO: 2490 - protein, 7 aa, Artificial Sequence
  Synthetic polypeptide
GASSMQS

SEQ ID NO: 2491 - protein, 9 aa, Artificial Sequence
  Synthetic polypeptide
QQSYSIPRT

SEQ ID NO: 2492 - protein, 118 aa, Artificial Sequence
  Synthetic polypeptide
QVQLQQWGAGLLKPSETLSLTCAVYDGSVSGFYWSWIRQPPGKGLEWIGEIDHSGSTNYNPSLKSRVTISVDTSKNQFSLKLSSVTAADSAVYYCARNGYSGYLFDYWGQGTLVTVSS

SEQ ID NO: 2493 - protein, 107 aa, Artificial Sequence
  Synthetic polypeptide
DIQMTQSPSSLSASVGDRVTITCRASQIISSYLNWYQQKPGKAPKVLIYGASSMQSGVPSRFSGSGYGTDFTLTISSLQPEDFATYYCQQSYSIPRTFGQGTKLEIK

SEQ ID NO: 2494 - protein, 240 aa, Artificial Sequence
  Synthetic polypeptide
QVQLQQWGAGLLKPSETLSLTCAVYDGSVSGFYWSWIRQPPGKGLEWIGEIDHSGSTNYNPSLKSRVTISVDTSKNQFSLKLSSVTAADSAVYYCARNGYSGYLFDYWGQGTLVTVSSGGGGSGGGGSGGGGSDIQMTQSPSSLSASVGDRVTITCRASQIISSYLNWYQQKPGKAPKVLIYGASSMQSGVPSRFSGSGYGTDFTLTISSLQPEDFATYYCQQSYSIPRTFGQGTKLEIK

SEQ ID NO: 2495 - protein, 495 aa, Artificial Sequence
  Synthetic polypeptide
QVQLQQWGAGLLKPSETLSLTCAVYDGSVSGFYWSWIRQPPGKGLEWIGEIDHSGSTNYNPSLKSRVTISVDTSKNQFSLKLSSVTAADSAVYYCARNGYSGYLFDYWGQGTLVTVSSGGGGSGGGGSGGGGSDIQMTQSPSSLSASVGDRVTITCRASQIISSYLNWYQQKPGKAPKVLIYGASSMQSGVPSRFSGSGYGTDFTLTISSLQPEDFATYYCQQSYSIPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2496 - protein, 5 aa, Artificial Sequence
  Synthetic polypeptide
TYYWS

SEQ ID NO: 2497 - protein, 16 aa, Artificial Sequence
  Synthetic polypeptide
RIYPTGITNYNPSLKS

SEQ ID NO: 2498 - protein, 17 aa, Artificial Sequence
  Synthetic polypeptide
DRRFLEPSYYYYYGMDV

SEQ ID NO: 2499 - protein, 16 aa, Artificial Sequence
  Synthetic polypeptide
RSSQSLLHSNGYNYLD

SEQ ID NO: 2500 - protein, 7 aa, Artificial Sequence
  Synthetic polypeptide
LGSNRAS

SEQ ID NO: 2501 - protein, 9 aa, Artificial Sequence
  Synthetic polypeptide
MQGLRTPFT

SEQ ID NO: 2502 - protein, 125 aa, Artificial Sequence
  Synthetic polypeptide
QVQLQESGPGLVKPSETLSLTCTVSGDSISTYYWSWIRQPAGKGLEWIGRIYPTGITNYNPSLKSRVTISVDTSKNQFSLKLSSVTAADTAVYYCARDRRFLEPSYYYYYGMDVWGQGTTVTVSS

SEQ ID NO: 2503 - protein, 112 aa, Artificial Sequence
  Synthetic polypeptide
DIVLTQSPLSLPVTPGEPASISCRSSQSLLHSNGYNYLDWYLQKPGQSPQLLIYLGSNRASGVPDRFSGSVSGTDFTLKISRVEAEDVGVYYCMQGLRTPFTFGPGTKLEIK

SEQ ID NO: 2504 - protein, 252 aa, Artificial Sequence
  Synthetic polypeptide
QVQLQESGPGLVKPSETLSLTCTVSGDSISTYYWSWIRQPAGKGLEWIGRIYPTGITNYNPSLKSRVTISVDTSKNQFSLKLSSVTAADTAVYYCARDRRFLEPSYYYYYGMDVWGQGTTVTVSSGGGGSGGGGSGGGGSDIVLTQSPLSLPVTPGEPASISCRSSQSLLHSNGYNYLDWYLQKPGQSPQLLIYLGSNRASGVPDRFSGSVSGTDFTLKISRVEAEDVGVYYCMQGLRTPFTFGPGTKLEIK

SEQ ID NO: 2505 - protein, 507 aa, Artificial Sequence
  Synthetic polypeptide
QVQLQESGPGLVKPSETLSLTCTVSGDSISTYYWSWIRQPAGKGLEWIGRIYPTGITNYNPSLKSRVTISVDTSKNQFSLKLSSVTAADTAVYYCARDRRFLEPSYYYYYGMDVWGQGTTVTVSSGGGGSGGGGSGGGGSDIVLTQSPLSLPVTPGEPASISCRSSQSLLHSNGYNYLDWYLQKPGQSPQLLIYLGSNRASGVPDRFSGSVSGTDFTLKISRVEAEDVGVYYCMQGLRTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2506 - protein, 5 aa, Artificial Sequence
  Synthetic polypeptide
SYAMS

SEQ ID NO: 2507 - protein, 17 aa, Artificial Sequence
  Synthetic polypeptide
VISDSGGITDFADSVKG

SEQ ID NO: 2508 - protein, 11 aa, Artificial Sequence
  Synthetic polypeptide
HDYSNYFFFDY

SEQ ID NO: 2509 - protein, 11 aa, Artificial Sequence
  Synthetic polypeptide
RASQSISNYLN

SEQ ID NO: 2510 - protein, 7 aa, Artificial Sequence
  Synthetic polypeptide
AASSLQS

SEQ ID NO: 2511 - protein, 9 aa, Artificial Sequence
  Synthetic polypeptide
QQSYIIPPT

SEQ ID NO: 2512 - protein, 120 aa, Artificial Sequence; identical to SEQ ID NO: 2382
  Synthetic polypeptide

SEQ ID NO: 2513 - protein, 107 aa, Artificial Sequence
  Synthetic polypeptide
DIQMTQSPSSLSASVGDRITITCRASQSISNYLNWYQQKPGKAPKLLISAASSLQSGVPSRFSGSGSGTDFTLTISSLQPEDFATYYCQQSYIIPPTFGQGTKVDIK

SEQ ID NO: 2514 - protein, 242 aa, Artificial Sequence
  Synthetic polypeptide
EVQLLESGGGLVQPGGSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRITITCRASQSISNYLNWYQQKPGKAPKLLISAASSLQSGVPSRFSGSGSGTDFTLTISSLQPEDFATYYCQQSYIIPPTFGQGTKVDIK

SEQ ID NO: 2515 - protein, 497 aa, Artificial Sequence
  Synthetic polypeptide
EVQLLESGGGLVQPGGSLRLSCAASGFTFSSYAMSWVRQAPGKGLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRITITCRASQSISNYLNWYQQKPGKAPKLLISAASSLQSGVPSRFSGSGSGTDFTLTISSLQPEDFATYYCQQSYIIPPTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2516 - protein, 5 aa, Artificial Sequence
  Synthetic polypeptide
SYSMN

SEQ ID NO: 2517 - protein, 17 aa, Artificial Sequence
  Synthetic polypeptide
YISSSGGYIYYADSVKG

SEQ ID NO: 2518 - protein, 11 aa, Artificial Sequence
  Synthetic polypeptide
GDYSNYAYFDY

SEQ ID NO: 2519 - protein, 11 aa, Artificial Sequence
  Synthetic polypeptide
RASQGISNYLA

SEQ ID NO: 2520 - protein, 7 aa, Artificial Sequence
  Synthetic polypeptide
AASTLQS

SEQ ID NO: 2521 - protein, 9 aa, Artificial Sequence
  Synthetic polypeptide
QQYYSTPLT

SEQ ID NO: 2522 - protein, 120 aa, Artificial Sequence
  Synthetic polypeptide
EVQLVESGGGLVKPGGSLRLSCAASGFTFSSYSMNWVRQAPGKGLEWVSYISSSGGYIYYADSVKGRFTISRDNAKNSLYLQMNSLRAEDAAVYYCSRGDYSNYAYFDYWGQGTLVTVSS

SEQ ID NO: 2523 - protein, 107 aa, Artificial Sequence
  Synthetic polypeptide
DIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIK

SEQ ID NO: 2524 - protein, 242 aa, Artificial Sequence
  Synthetic polypeptide
EVQLVESGGGLVKPGGSLRLSCAASGFTFSSYSMNWVRQAPGKGLEWVSYISSSGGYIYYADSVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIK

SEQ ID NO: 2525 - protein, 497 aa, Artificial Sequence
  Synthetic polypeptide
EVQLVESGGGLVKPGGSLRLSCAASGFTFSSYSMNWVRQAPGKGLEWVSYISSSGGYIYYADSVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2526 - protein, 5 aa, Artificial Sequence
  Synthetic polypeptide
TYTMN

SEQ ID NO: 2527 - protein, 17 aa, Artificial Sequence
  Synthetic polypeptide
SISSSSGYIYYADSVKG

SEQ ID NO: 2528 - protein, 11 aa, Artificial Sequence
  Synthetic polypeptide
GDYSNYLYFDL

SEQ ID NO: 2529 - protein, 12 aa, Artificial Sequence
  Synthetic polypeptide
RASQSFRSSYLA

SEQ ID NO: 2530 - protein, 7 aa, Artificial Sequence
  Synthetic polypeptide
GASSRAT

SEQ ID NO: 2531 - protein, 9 aa, Artificial Sequence
  Synthetic polypeptide
QLYGSLPIT

SEQ ID NO: 2532 - protein, 120 aa, Artificial Sequence
  Synthetic polypeptide
EVQLVESGGGLVKPGGSLRLSCAASGITFSTYTMNWVRQAPGKGLEWVSSISSSSGYIYYADSVKGRFTISRDNAKNSLYLQMNSLRAEDTAVYYCARGDYSNYLYFDLWGRGTLVTVSS

SEQ ID NO: 2533 - protein, 108 aa, Artificial Sequence
  Synthetic polypeptide
EIVLTQSPGTLSLSPGERATLSCRASQSFRSSYLAWYQQKPGQAPRLLIHGASSRATGIPDRFSGSGSGTDFTLTISRLEPEDFAVYYCQLYGSLPITFGQGTRLEIK

SEQ ID NO: 2534 - protein, 243 aa, Artificial Sequence
  Synthetic polypeptide
EVQLVESGGGLVKPGGSLRLSCAASGITFSTYTMNWVRQAPGKGLEWVSSISSSSGYIYYADSVKGRFTISRDNAKNSLYLQMNSLRAEDTAVYYCARGDYSNYLYFDLWGRGTLVTVSSGGGGSGGGGSGGGGSEIVLTQSPGTLSLSPGERATLSCRASQSFRSSYLAWYQQKPGQAPRLLIHGASSRATGIPDRFSGSGSGTDFTLTISRLEPEDFAVYYCQLYGSLPITFGQGTRLEIK

SEQ ID NO: 2535 - protein, 498 aa, Artificial Sequence
  Synthetic polypeptide
EVQLVESGGGLVKPGGSLRLSCAASGITFSTYTMNWVRQAPGKGLEWVSSISSSSGYIYYADSVKGRFTISRDNAKNSLYLQMNSLRAEDTAVYYCARGDYSNYLYFDLWGRGTLVTVSSGGGGSGGGGSGGGGSEIVLTQSPGTLSLSPGERATLSCRASQSFRSSYLAWYQQKPGQAPRLLIHGASSRATGIPDRFSGSGSGTDFTLTISRLEPEDFAVYYCQLYGSLPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2536 - protein, 5 aa, Artificial Sequence
  Synthetic polypeptide
VYAMS

SEQ ID NO: 2537 - protein, 17 aa, Artificial Sequence
  Synthetic polypeptide
TISDSGGSTFYADSVKG

SEQ ID NO: 2538 - protein, 11 aa, Artificial Sequence
  Synthetic polypeptide
HDYSNYAYFDY

SEQ ID NO: 2539 - protein, 12 aa, Artificial Sequence
  Synthetic polypeptide
RASQSVRSSYLA

SEQ ID NO: 2540 - protein, 7 aa, Artificial Sequence
  Synthetic polypeptide
GASSRAT

SEQ ID NO: 2541 - protein, 9 aa, Artificial Sequence
  Synthetic polypeptide
QQYGDLPFT

SEQ ID NO: 2542 - protein, 120 aa, Artificial Sequence
  Synthetic polypeptide
EVQLLESGGGLVQPGGSLRLSCAASGFTFSVYAMSWVRQAPGKCLEWVSTISDSGGSTFYADSVKGRFTISRDNSKNTLYLQMNRLRAEDTAVYYCARHDYSNYAYFDYWGQGTLVTVSS

SEQ ID NO: 2543 - protein, 108 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK

SEQ ID NO: 2544 - protein, 243 aa, Artificial Sequence
  Synthetic polypeptide
EVQLLESGGGLVQPGGSLRLSCAASGFTFSVYAMSWVRQAPGKCLEWVSTISDSGGSTFYADSVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK

SEQ ID NO: 2545 - protein, 498 aa, Artificial Sequence
  Synthetic polypeptide
EVQLLESGGGLVQPGGSLRLSCAASGFTFSVYAMSWVRQAPGKCLEWVSTISDSGGSTFYADSVKGRFTISRDNSKNTLYLQMNRLRAEDTAVYYCARHDYSNYAYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2546 - protein, 5 aa, Artificial Sequence
  Synthetic polypeptide
TYAMS

SEQ ID NO: 2547 - protein, 17 aa, Artificial Sequence
  Synthetic polypeptide
AISGSGGYTYYADSVEG

SEQ ID NO: 2548 - protein, 11 aa, Artificial Sequence
  Synthetic polypeptide
HDYSNYAWFDP

SEQ ID NO: 2549 - protein, 12 aa, Artificial Sequence
  Synthetic polypeptide
RASQSVSSAYLA

SEQ ID NO: 2550 - protein, 7 aa, Artificial Sequence
  Synthetic polypeptide
GASSRAT

SEQ ID NO: 2551 - protein, 9 aa, Artificial Sequence
  Synthetic polypeptide
QQFGSSPFT

SEQ ID NO: 2552 - protein, 120 aa, Artificial Sequence
  Synthetic polypeptide
EVQLLESGGGLVQPGGSLRLSCAASGFTFSTYAMSWVRQAPGKCLDWVSAISGSGGYTYYADSVEGRFTISRDNSRNTLYLQMNSLRAEDTAVYYCASHDYSNYAWFDPWGQGTLVTVSS

SEQ ID NO: 2553 - protein, 108 aa, Artificial Sequence
  Synthetic polypeptide
EIVLTQSPGTLSLSPGERATLSCRASQSVSSAYLAWYQQKPGQAPRLLIYGASSRATGIPDRFSGSGSGTDFTLTISRLEPEDFAVYYCQQFGSSPFTFGCGTKVEIK

SEQ ID NO: 2554 - protein, 243 aa, Artificial Sequence
  Synthetic polypeptide
EVQLLESGGGLVQPGGSLRLSCAASGFTFSTYAMSWVRQAPGKCLDWVSAISGSGGYTYYADSVEGRFTISRDNSRNTLYLQMNSLRAEDTAVYYCASHDYSNYAWFDPWGQGTLVTVSSGGGGSGGGGSGGGGSEIVLTQSPGTLSLSPGERATLSCRASQSVSSAYLAWYQQKPGQAPRLLIYGASSRATGIPDRFSGSGSGTDFTLTISRLEPEDFAVYYCQQFGSSPFTFGCGTKVEIK

SEQ ID NO: 2555 - protein, 498 aa, Artificial Sequence
  Synthetic polypeptide
EVQLLESGGGLVQPGGSLRLSCAASGFTFSTYAMSWVRQAPGKCLDWVSAISGSGGYTYYADSVEGRFTISRDNSRNTLYLQMNSLRAEDTAVYYCASHDYSNYAWFDPWGQGTLVTVSSGGGGSGGGGSGGGGSEIVLTQSPGTLSLSPGERATLSCRASQSVSSAYLAWYQQKPGQAPRLLIYGASSRATGIPDRFSGSGSGTDFTLTISRLEPEDFAVYYCQQFGSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2556 - protein, 5 aa, Artificial Sequence
  Synthetic polypeptide
SYAMS

SEQ ID NO: 2557 - protein, 17 aa, Artificial Sequence
  Synthetic polypeptide
AISGSGGRTYYADSVKG

SEQ ID NO: 2558 - protein, 11 aa, Artificial Sequence
  Synthetic polypeptide
HDYSNYPYFDY

SEQ ID NO: 2559 - protein, 12 aa, Artificial Sequence
  Synthetic polypeptide
RASQSVRGSYLA

SEQ ID NO: 2560 - protein, 7 aa, Artificial Sequence
  Synthetic polypeptide
SASSRAT

SEQ ID NO: 2561 - protein, 9 aa, Artificial Sequence
  Synthetic polypeptide
QQYGDSPFT

SEQ ID NO: 2562 - protein, 120 aa, Artificial Sequence
  Synthetic polypeptide
EVQLLESGGGLVQPGGSLRLSCAASGFTFSSYAMSWVRQAPGQCLEWVSAISGSGGRTYYADSVKGRFTISRDNSKNTLYLQMNSLRAEDTAVYYCAKHDYSNYPYFDYWGQGTLVTVSS

SEQ ID NO: 2563 - protein, 108 aa, Artificial Sequence
  Synthetic polypeptide
EIVLTQSPGTLSLSPGERATLSCRASQSVRGSYLAWYQQKPGQAPRLLIYSASSRATGIPDRFSGSGSGTDFTLTISRLEPEDFAVYYCQQYGDSPFTFGCGTKVEIK

SEQ ID NO: 2564 - protein, 243 aa, Artificial Sequence
  Synthetic polypeptide
EVQLLESGGGLVQPGGSLRLSCAASGFTFSSYAMSWVRQAPGQCLEWVSAISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRGSYLAWYQQKPGQAPRLLIYSASSRATGIPDRFSGSGSGTDFTLTISRLEPEDFAVYYCQQYGDSPFTFGCGTKVEIK

SEQ ID NO: 2565 - protein, 498 aa, Artificial Sequence
  Synthetic polypeptide
EVQLLESGGGLVQPGGSLRLSCAASGFTFSSYAMSWVRQAPGQCLEWVSAISGSGGRTYYADSVKGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRGSYLAWYQQKPGQAPRLLIYSASSRATGIPDRFSGSGSGTDFTLTISRLEPEDFAVYYCQQYGDSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2566 - protein, 5 aa, Artificial Sequence
  Synthetic polypeptide
SYAMS

SEQ ID NO: 2567 - protein, 17 aa, Artificial Sequence
  Synthetic polypeptide
VISDSGGITDFADSVKG

SEQ ID NO: 2568 - protein, 11 aa, Artificial Sequence
  Synthetic polypeptide
HDYSNYFFFDY

SEQ ID NO: 2569 - protein, 11 aa, Artificial Sequence
  Synthetic polypeptide
RASQDISNYLN

SEQ ID NO: 2570 - protein, 7 aa, Artificial Sequence
  Synthetic polypeptide
AASSLQS

SEQ ID NO: 2571 - protein, 9 aa, Artificial Sequence
  Synthetic polypeptide
QQSYISPPT

SEQ ID NO: 2572 - protein, 120 aa, Artificial Sequence
  Synthetic polypeptide
EVQLLESGGGLVQPGGSLRLSCAASGFTFSSYAMSWVRQAPGKCLEWVSVISDSGGITDFADSVKGRFIISRDNSRNTLYLQMNSLRAEDTAVYFCARHDYSNYFFFDYWGQGTLVTVSS

SEQ ID NO: 2573 - protein, 107 aa, Artificial Sequence
  Synthetic polypeptide
DIQMTQSPSSLSASVGDRVTITCRASQDISNYLNWYQQKSGKAPELLIYAASSLQSGVPSRFSGSGSGTDFTLTISSLQPEDFATYYCQQSYISPPTFGCGTKVEIK

SEQ ID NO: 2574 - protein, 242 aa, Artificial Sequence
  Synthetic polypeptide
EVQLLESGGGLVQPGGSLRLSCAASGFTFSSYAMSWVRQAPGKCLEWVSVISDSGGITDFADSVKGRFIISRDNSRNTLYLQMNSLRAEDTAVYFCARHDYSNYFFFDYWGQGTLVTVSSGGGGSGGGGSGGGGSDIQMTQSPSSLSASVGDRVTITCRASQDISNYLNWYQQKSGKAPELLIYAASSLQSGVPSRFSGSGSGTDFTLTISSLQPEDFATYYCQQSYISPPTFGCGTKVEIK

SEQ ID NO: 2575 - protein, 497 aa, Artificial Sequence
  Synthetic polypeptide
EVQLLESGGGLVQPGGSLRLSCAASGFTFSSYAMSWVRQAPGKCLEWVSVISDSGGITDFADSVKGRFIISRDNSRNTLYLQMNSLRAEDTAVYFCARHDYSNYFFFDYWGQGTLVTVSSGGGGSGGGGSGGGGSDIQMTQSPSSLSASVGDRVTITCRASQDISNYLNWYQQKSGKAPELLIYAASSLQSGVPSRFSGSGSGTDFTLTISSLQPEDFATYYCQQSYISPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2576 - protein, 5 aa, Artificial Sequence
  Synthetic polypeptide
SYAMS

SEQ ID NO: 2577 - protein, 17 aa, Artificial Sequence
  Synthetic polypeptide
VISDSGGITDFADSVKG

SEQ ID NO: 2578 - protein, 11 aa, Artificial Sequence
  Synthetic polypeptide
HDYSNYFFFDY

SEQ ID NO: 2579 - protein, 11 aa, Artificial Sequence
  Synthetic polypeptide
RASQGISNYLA

SEQ ID NO: 2580 - protein, 7 aa, Artificial Sequence
  Synthetic polypeptide
AASILQS

SEQ ID NO: 2581 - protein, 9 aa, Artificial Sequence
  Synthetic polypeptide
QQYFAYPIT

SEQ ID NO: 2582 - protein, 120 aa, Artificial Sequence
  Synthetic polypeptide
EVQLLESGGGLVQPGGSLRLSCAASGFTFSSYAMSWVRQAPGKCLEWVSVISDSGGITDFADSVKGRFTISRDNSRNTLYLQMNSLRAEDTAVYFCARHDYSNYFFFDYWGQGTLVTVSS

SEQ ID NO: 2583 - protein, 107 aa, Artificial Sequence
  Synthetic polypeptide
DIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIK

SEQ ID NO: 2584 - protein, 242 aa, Artificial Sequence
  Synthetic polypeptide
EVQLLESGGGLVQPGGSLRLSCAASGFTFSSYAMSWVRQAPGKCLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIK

SEQ ID NO: 2585 - protein, 497 aa, Artificial Sequence
  Synthetic polypeptide
EVQLLESGGGLVQPGGSLRLSCAASGFTFSSYAMSWVRQAPGKCLEWVSVISDSGGITDFADSVKGRFTISRDNSRNTLYLQMNSLRAEDTAVYFCARHDYSNYFFFDYWGQGTLVTVSSGGGGSGGGGSGGGGSDIQMTQSPSSLSASVGDRVTITCRASQGISNYLAWYQQKPGKVPKLLIYAASILQSGVPSKFSGSGSGTDFTLTISSLQPEDFAIYYCQQYFAYPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2586 - protein, 7 aa, Artificial Sequence
  Synthetic polypeptide
TDGYYWS

SEQ ID NO: 2587 - protein, 16 aa, Artificial Sequence
  Synthetic polypeptide
YIYYSGSTNYNPSLKS

SEQ ID NO: 2588 - protein, 8 aa, Artificial Sequence
  Synthetic polypeptide
GIGLGFEY

SEQ ID NO: 2589 - protein, 11 aa, Artificial Sequence
  Synthetic polypeptide
GGNNIGSKSVH

SEQ ID NO: 2590 - protein, 7 aa, Artificial Sequence
  Synthetic polypeptide
DDSDRPS

SEQ ID NO: 2591 - protein, 12 aa, Artificial Sequence
  Synthetic polypeptide
QVWDRSSDQDVV

SEQ ID NO: 2592 - protein, 118 aa, Artificial Sequence
  Synthetic polypeptide
QVQLQESGPGLVKPSETLSLTCTVSGGSVSTDGYYWSWIRQPPGKCLEWIGYIYYSGSTNYNPSLKSRVTISVDTSKNQFSLKLISVTAADTAVYYCARGIGLGFEYWGQGTLVTVSS

SEQ ID NO: 2593 - protein, 109 aa, Artificial Sequence
  Synthetic polypeptide
SYVLTQLSSVSVAPGQTARITCGGNNIGSKSVHWYQQKPGQAPVLVVYDDSDRPSGIPERFSGSNSGNTATLTISRVEAGDEADYYCQVWDRSSDQDVVFGCGTKLTVL

SEQ ID NO: 2594 - protein, 242 aa, Artificial Sequence
  Synthetic polypeptide
QVQLQESGPGLVKPSETLSLTCTVSGGSVSTDGYYWSWIRQPPGKCLEWIGYIYYSGSTNYNPSLKSRVTISVDTSKNQFSLKLISVTAADTAVYYCARGIGLGFEYWGQGTLVTVSSGGGGSGGGGSGGGGSSYVLTQLSSVSVAPGQTARITCGGNNIGSKSVHWYQQKPGQAPVLVVYDDSDRPSGIPERFSGSNSGNTATLTISRVEAGDEADYYCQVWDRSSDQDVVFGCGTKLTVL

SEQ ID NO: 2595 - protein, 497 aa, Artificial Sequence
  Synthetic polypeptide
QVQLQESGPGLVKPSETLSLTCTVSGGSVSTDGYYWSWIRQPPGKCLEWIGYIYYSGSTNYNPSLKSRVTISVDTSKNQFSLKLISVTAADTAVYYCARGIGLGFEYWGQGTLVTVSSGGGGSGGGGSGGGGSSYVLTQLSSVSVAPGQTARITCGGNNIGSKSVHWYQQKPGQAPVLVVYDDSDRPSGIPERFSGSNSGNTATLTISRVEAGDEADYYCQVWDRSSDQDVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2596 - protein, 5 aa, Artificial Sequence
  Synthetic polypeptide
SYGMH

SEQ ID NO: 2597 - protein, 17 aa, Artificial Sequence
  Synthetic polypeptide
VISYDGSNKYYADSVKG

SEQ ID NO: 2598 - protein, 15 aa, Artificial Sequence
  Synthetic polypeptide
GRYYGSGNYNHGMDV

SEQ ID NO: 2599 - protein, 11 aa, Artificial Sequence
  Synthetic polypeptide
RASQSISSYLN

SEQ ID NO: 2600 - protein, 7 aa, Artificial Sequence
  Synthetic polypeptide
AASSLQS

SEQ ID NO: 2601 - protein, 9 aa, Artificial Sequence
  Synthetic polypeptide
QQSYSTPFT

SEQ ID NO: 2602 - protein, 124 aa, Artificial Sequence
  Synthetic polypeptide
QVQLVESGGGVVQPGRSLRLSCAASGFMFSSYGMHWVRQAPGKCLEWVAVISYDGSNKYYADSVKGRFTISRDNSKNTLYLQMNSLRAEDTAVYYCARGRYYGSGNYNHGMDVWGQGTTVTVSS

SEQ ID NO: 2603 - protein, 107 aa, Artificial Sequence
  Synthetic polypeptide
DIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIK

SEQ ID NO: 2604 - protein, 246 aa, Artificial Sequence
  Synthetic polypeptide
QVQLVESGGGVVQPGRSLRLSCAASGFMFSSYGMHWVRQAPGKCLEWVAVISYDGSNKYYADSVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIK

SEQ ID NO: 2605 - protein, 501 aa, Artificial Sequence
  Synthetic polypeptide
QVQLVESGGGVVQPGRSLRLSCAASGFMFSSYGMHWVRQAPGKCLEWVAVISYDGSNKYYADSVKGRFTISRDNSKNTLYLQMNSLRAEDTAVYYCARGRYYGSGNYNHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGRGSGTDFTLTISSLQPEDFATYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2606 - protein, 5 aa, Artificial Sequence
  Synthetic polypeptide
SYGMH

SEQ ID NO: 2607 - protein, 17 aa, Artificial Sequence
  Synthetic polypeptide
VISYDGSNKYYADSVKG

SEQ ID NO: 2608 - protein, 15 aa, Artificial Sequence
  Synthetic polypeptide
GRYYGSGSYNYGMDV

SEQ ID NO: 2609 - protein, 11 aa, Artificial Sequence
  Synthetic polypeptide
RASQSIFDYLN

SEQ ID NO: 2610 - protein, 7 aa, Artificial Sequence
  Synthetic polypeptide
AASSLQS

SEQ ID NO: 2611 - protein, 9 aa, Artificial Sequence
  Synthetic polypeptide
QQSYSTPLT

SEQ ID NO: 2612 - protein, 124 aa, Artificial Sequence
  Synthetic polypeptide
QVQLVESGGGVVQPGRSLRLSCAASGFTFSSYGMHWVRQAPGKCLEWVAVISYDGSNKYYADSVKGRFTISRDNSKNTLYLQMNSLRAEDTAVYYCARGRYYGSGSYNYGMDVWGQGTTVTVSS

SEQ ID NO: 2613 - protein, 107 aa, Artificial Sequence
  Synthetic polypeptide
DIQMTQSPSSLSASVGDRVTITCRASQSIFDYLNWYQQKPGKAPKLLIYAASSLQSGVPSRFSGSGFGTDFTLTISSLQPEDFATYYCQQSYSTPLTFGCGTKLEIK

SEQ ID NO: 2614 - protein, 246 aa, Artificial Sequence
  Synthetic polypeptide
QVQLVESGGGVVQPGRSLRLSCAASGFTFSSYGMHWVRQAPGKCLEWVAVISYDGSNKYYADSVKGRFTISRDNSKNTLYLQMNSLRAEDTAVYYCARGRYYGSGSYNYGMDVWGQGTTVTVSSGGGGSGGGGSGGGGSDIQMTQSPSSLSASVGDRVTITCRASQSIFDYLNWYQQKPGKAPKLLIYAASSLQSGVPSRFSGSGFGTDFTLTISSLQPEDFATYYCQQSYSTPLTFGCGTKLEIK

SEQ ID NO: 2615 - protein, 501 aa, Artificial Sequence
  Synthetic polypeptide
QVQLVESGGGVVQPGRSLRLSCAASGFTFSSYGMHWVRQAPGKCLEWVAVISYDGSNKYYADSVKGRFTISRDNSKNTLYLQMNSLRAEDTAVYYCARGRYYGSGSYNYGMDVWGQGTTVTVSSGGGGSGGGGSGGGGSDIQMTQSPSSLSASVGDRVTITCRASQSIFDYLNWYQQKPGKAPKLLIYAASSLQSGVPSRFSGSGFGTDFTLTISSLQPEDFATYYCQQSYSTPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2616 - protein, 5 aa, Artificial Sequence
  Synthetic polypeptide
TYYWS

SEQ ID NO: 2617 - protein, 16 aa, Artificial Sequence
  Synthetic polypeptide
RIYPTGITNYNPSLKS

SEQ ID NO: 2618 - protein, 17 aa, Artificial Sequence
  Synthetic polypeptide
DRRFLEPSYYYYYGMDV

SEQ ID NO: 2619 - protein, 16 aa, Artificial Sequence
  Synthetic polypeptide
RSSQSLLHSNGYNYLD

SEQ ID NO: 2620 - protein, 7 aa, Artificial Sequence
  Synthetic polypeptide
LGSNRAS

SEQ ID NO: 2621 - protein, 9 aa, Artificial Sequence
  Synthetic polypeptide
MQGLRTPFT

SEQ ID NO: 2622 - protein, 125 aa, Artificial Sequence
  Synthetic polypeptide
QVQLQESGPGLVKPSETLSLTCTVSGDSISTYYWSWIRQPAGKCLEWIGRIYPTGITNYNPSLKSRVTISVDTSKNQFSLKLSSVTAADTAVYYCARDRRFLEPSYYYYYGMDVWGQGTTVTVSS

SEQ ID NO: 2623 - protein, 112 aa, Artificial Sequence
  Synthetic polypeptide
DIVLTQSPLSLPVTPGEPASISCRSSQSLLHSNGYNYLDWYLQKPGQSPQLLIYLGSNRASGVPDRFSGSVSGTDFTLKISRVEAEDVGVYYCMQGLRTPFTFGCGTKLEIK

SEQ ID NO: 2624 - protein, 252 aa, Artificial Sequence
  Synthetic polypeptide
QVQLQESGPGLVKPSETLSLTCTVSGDSISTYYWSWIRQPAGKCLEWIGRIYPTGITNYNPSLKSRVTISVDTSKNQFSLKLSSVTAADTAVYYCARDRRFLEPSYYYYYGMDVWGQGTTVTVSSGGGGSGGGGSGGGGSDIVLTQSPLSLPVTPGEPASISCRSSQSLLHSNGYNYLDWYLQKPGQSPQLLIYLGSNRASGVPDRFSGSVSGTDFTLKISRVEAEDVGVYYCMQGLRTPFTFGCGTKLEIK

SEQ ID NO: 2625 - protein, 507 aa, Artificial Sequence
  Synthetic polypeptide
QVQLQESGPGLVKPSETLSLTCTVSGDSISTYYWSWIRQPAGKCLEWIGRIYPTGITNYNPSLKSRVTISVDTSKNQFSLKLSSVTAADTAVYYCARDRRFLEPSYYYYYGMDVWGQGTTVTVSSGGGGSGGGGSGGGGSDIVLTQSPLSLPVTPGEPASISCRSSQSLLHSNGYNYLDWYLQKPGQSPQLLIYLGSNRASGVPDRFSGSVSGTDFTLKISRVEAEDVGVYYCMQGLRTPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2626 - protein, 5 aa, Artificial Sequence
  Synthetic polypeptide
SYSMN

SEQ ID NO: 2627 - protein, 17 aa, Artificial Sequence
  Synthetic polypeptide
YISSSGGYIYYADSVKG

SEQ ID NO: 2628 - protein, 11 aa, Artificial Sequence
  Synthetic polypeptide
GDYSNYAYFDY

SEQ ID NO: 2629 - protein, 11 aa, Artificial Sequence
  Synthetic polypeptide
RASQGISNYLA

SEQ ID NO: 2630 - protein, 7 aa, Artificial Sequence
  Synthetic polypeptide
AASTLQS

SEQ ID NO: 2631 - protein, 9 aa, Artificial Sequence
  Synthetic polypeptide
QQYYSTPLT

SEQ ID NO: 2632 - protein, 120 aa, Artificial Sequence
  Synthetic polypeptide
EVQLVESGGGLVKPGGSLRLSCAASGFTFSSYSMNWVRQAPGKCLEWVSYISSSGGYIYYADSVKGRFTISRDNAKNSLYLQMNSLRAEDAAVYYCSRGDYSNYAYFDYWGQGTLVTVSS

SEQ ID NO: 2633 - protein, 107 aa, Artificial Sequence
  Synthetic polypeptide
DIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIK

SEQ ID NO: 2634 - protein, 242 aa, Artificial Sequence
  Synthetic polypeptide
EVQLVESGGGLVKPGGSLRLSCAASGFTFSSYSMNWVRQAPGKCLEWVSYISSSGGYIYYADSVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIK

SEQ ID NO: 2635 - protein, 497 aa, Artificial Sequence
  Synthetic polypeptide
EVQLVESGGGLVKPGGSLRLSCAASGFTFSSYSMNWVRQAPGKCLEWVSYISSSGGYIYYADSVKGRFTISRDNAKNSLYLQMNSLRAEDAAVYYCSRGDYSNYAYFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2636 - protein, 5 aa, Artificial Sequence
  Synthetic polypeptide
SYAMS

SEQ ID NO: 2637 - protein, 17 aa, Artificial Sequence
  Synthetic polypeptide
AISGSGGSTFYADSVQG

SEQ ID NO: 2638 - protein, 11 aa, Artificial Sequence
  Synthetic polypeptide
HDYSNYPYFDY

SEQ ID NO: 2639 - protein, 12 aa, Artificial Sequence
  Synthetic polypeptide
RASQSVRGNYLA

SEQ ID NO: 2640 - protein, 7 aa, Artificial Sequence
  Synthetic polypeptide
GASSRAT

SEQ ID NO: 2641 - protein, 9 aa, Artificial Sequence
  Synthetic polypeptide
QQYGYSPFT

SEQ ID NO: 2642 - protein, 120 aa, Artificial Sequence
  Synthetic polypeptide
EVQLLESGGGLVQPGGSLRLSCAASGFTFSSYAMSWVRQAPGKGLEWVSAISGSGGSTFYADSVQGRFTISRDNSKNTLYLQVNSLRAEDTAVYYCARHDYSNYPYFDYWGQGTLVTVSS

SEQ ID NO: 2643 - protein, 108 aa, Artificial Sequence
  Synthetic polypeptide
EIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVDIK

SEQ ID NO: 2644 - protein, 243 aa, Artificial Sequence
  Synthetic polypeptide
EVQLLESGGGLVQPGGSLRLSCAASGFTFSSYAMSWVRQAPGKGLEWVSAISGSGGSTFYADSVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVDIK

SEQ ID NO: 2645 - protein, 498 aa, Artificial Sequence
  Synthetic polypeptide
EVQLLESGGGLVQPGGSLRLSCAASGFTFSSYAMSWVRQAPGKGLEWVSAISGSGGSTFYADSVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2646 - protein, 5 aa, Artificial Sequence
  Synthetic polypeptide
TYAMS

SEQ ID NO: 2647 - protein, 16 aa, Artificial Sequence
  Synthetic polypeptide
SMSSGGSLYYPDTVKG

SEQ ID NO: 2648 - protein, 7 aa, Artificial Sequence
  Synthetic polypeptide
GGYGTSY

SEQ ID NO: 2649 - protein, 16 aa, Artificial Sequence
  Synthetic polypeptide
RSSQSIVHSIGDTYLE

SEQ ID NO: 2650 - protein, 7 aa, Artificial Sequence
  Synthetic polypeptide
KVSNRFS

SEQ ID NO: 2651 - protein, 9 aa, Artificial Sequence
  Synthetic polypeptide
FQGSHFPYT

SEQ ID NO: 2652 - protein, 115 aa, Artificial Sequence
  Synthetic polypeptide
EVQLVESGGGLVQPGGSLRLSCAASGFTVSTYAMSWVRQTPGKRLEWVASMSSGGSLYYPDTVKGRFTISRDTSKNTVYLQMNSLRAEDTAVYYCVRGGYGTSYWGQGTLVTVSS

SEQ ID NO: 2653 - protein, 112 aa, Artificial Sequence
  Synthetic polypeptide
DIVMTQTPLSLSVTPGEPASISCRSSQSIVHSIGDTYLEWYLQKPGQSPQLLIYKVSNRFSGVPDRFSGSGSGTDFTLKISRVEAEDVGVYYCFQGSHFPYTFGQGTKLEIK

SEQ ID NO: 2654 - protein, 242 aa, Artificial Sequence
  Synthetic polypeptide
EVQLVESGGGLVQPGGSLRLSCAASGFTVSTYAMSWVRQTPGKRLEWVASMSSGGSLYYPDTVKGRFTISRDTSKNTVYLQMNSLRAEDTAVYYCVRGGYGTSYWGQGTLVTVSSGGGGSGGGGSGGGGSDIVMTQTPLSLSVTPGEPASISCRSSQSIVHSIGDTYLEWYLQKPGQSPQLLIYKVSNRFSGVPDRFSGSGSGTDFTLKISRVEAEDVGVYYCFQGSHFPYTFGQGTKLEIK

SEQ ID NO: 2655 - protein, 1094 aa, Artificial Sequence
  Synthetic polypeptide
EVQLVESGGGLVQPGGSLRLSCAASGFTVSTYAMSWVRQTPGKRLEWVASMSSGGSLYYPDTVKGRFTISRDTSKNTVYLQMNSLRAEDTAVYYCVRGGYGTSYWGQGTLVTVSSGGGGSGGGGSGGGGSDIVMTQTPLSLSVTPGEPASISCRSSQSIVHSIGDTYLEWYLQKPGQSPQLLIYKVSNRFSGVPDRFSGSGSGTDFTLKISRVEAEDVGVYYCFQGSHFPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 2656 - protein, 5 aa, Artificial Sequence
  Synthetic polypeptide
TYAMS

SEQ ID NO: 2657 - protein, 16 aa, Artificial Sequence
  Synthetic polypeptide
SMSSGGSLYYPDTVKG

SEQ ID NO: 2658 - protein, 7 aa, Artificial Sequence
  Synthetic polypeptide
GGYGTSY

SEQ ID NO: 2659 - protein, 16 aa, Artificial Sequence
  Synthetic polypeptide
RSSQSIVHSIGDTYLE

SEQ ID NO: 2660 - protein, 7 aa, Artificial Sequence
  Synthetic polypeptide
KVSNRFS

SEQ ID NO: 2661 - protein, 9 aa, Artificial Sequence
  Synthetic polypeptide
FQGSHFPYT

SEQ ID NO: 2662 - protein, 115 aa, Artificial Sequence
  Synthetic polypeptide
EVQLVESGGGLVQPGGSLRLSCAASGFTVSTYAMSWVRQTPEKRLEWVASMSSGGSLYYPDTVKGRFTISRDNSKNIVYLQMNSLRAEDTAVYYCVRGGYGTSYWGQGTLVTVSS

SEQ ID NO: 2663 - protein, 112 aa, Artificial Sequence; identical to SEQ ID NO: 2653
  Synthetic polypeptide

SEQ ID NO: 2664 - protein, 242 aa, Artificial Sequence
  Synthetic polypeptide
EVQLVESGGGLVQPGGSLRLSCAASGFTVSTYAMSWVRQTPEKRLEWVASMSSGGSLYYPDTVKGRFTISRDNSKNIVYLQMNSLRAEDTAVYYCVRGGYGTSYWGQGTLVTVSSGGGGSGGGGSGGGGSDIVMTQTPLSLSVTPGEPASISCRSSQSIVHSIGDTYLEWYLQKPGQSPQLLIYKVSNRFSGVPDRFSGSGSGTDFTLKISRVEAEDVGVYYCFQGSHFPYTFGQGTKLEIK

SEQ ID NO: 2665 - protein, 1094 aa, Artificial Sequence
  Synthetic polypeptide
EVQLVESGGGLVQPGGSLRLSCAASGFTVSTYAMSWVRQTPEKRLEWVASMSSGGSLYYPDTVKGRFTISRDNSKNIVYLQMNSLRAEDTAVYYCVRGGYGTSYWGQGTLVTVSSGGGGSGGGGSGGGGSDIVMTQTPLSLSVTPGEPASISCRSSQSIVHSIGDTYLEWYLQKPGQSPQLLIYKVSNRFSGVPDRFSGSGSGTDFTLKISRVEAEDVGVYYCFQGSHFPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 2666 - protein, 5 aa, Artificial Sequence
  Synthetic polypeptide
TYAMS

SEQ ID NO: 2667 - protein, 16 aa, Artificial Sequence
  Synthetic polypeptide
SMSSGGSLYYPDTVKG

SEQ ID NO: 2668 - protein, 7 aa, Artificial Sequence
  Synthetic polypeptide
GGYGTSY

SEQ ID NO: 2669 - protein, 16 aa, Artificial Sequence
  Synthetic polypeptide
RSSQSIVHSIGDTYLE

SEQ ID NO: 2670 - protein, 7 aa, Artificial Sequence
  Synthetic polypeptide
KVSNRFS

SEQ ID NO: 2671 - protein, 9 aa, Artificial Sequence
  Synthetic polypeptide
FQGSHFPYT

SEQ ID NO: 2672 - protein, 115 aa, Artificial Sequence; identical to SEQ ID NO: 2662
  Synthetic polypeptide

SEQ ID NO: 2673 - protein, 112 aa, Artificial Sequence
  Synthetic polypeptide
DIVMTQTPLSLSVTPGEPASISCRSSQSIVHSIGDTYLEWYLQKPGQSPKLLIYKVSNRFSGVPDRFSGSGSGTDFTLKISRVEAEDVGVYYCFQGSHFPYTFGQGTKLEIK

SEQ ID NO: 2674 - protein, 242 aa, Artificial Sequence
  Synthetic polypeptide
EVQLVESGGGLVQPGGSLRLSCAASGFTVSTYAMSWVRQTPEKRLEWVASMSSGGSLYYPDTVKGRFTISRDNSKNIVYLQMNSLRAEDTAVYYCVRGGYGTSYWGQGTLVTVSSGGGGSGGGGSGGGGSDIVMTQTPLSLSVTPGEPASISCRSSQSIVHSIGDTYLEWYLQKPGQSPKLLIYKVSNRFSGVPDRFSGSGSGTDFTLKISRVEAEDVGVYYCFQGSHFPYTFGQGTKLEIK

SEQ ID NO: 2675 - protein, 1094 aa, Artificial Sequence [sequence omitted]

SEQ ID NO: 2676 - protein, 5 aa, Artificial Sequence
  Synthetic polypeptide
GSWMN

SEQ ID NO: 2677 - protein, 17 aa, Artificial Sequence
  Synthetic polypeptide
RIYPGDGDTNYNGKFKG

SEQ ID NO: 2678 - protein, 15 aa, Artificial Sequence
  Synthetic polypeptide
DDGYYVAFDYYAMDY

SEQ ID NO: 2679 - protein, 15 aa, Artificial Sequence
  Synthetic polypeptide
KSSQSLSRASYSYLH

SEQ ID NO: 2680 - protein, 7 aa, Artificial Sequence
  Synthetic polypeptide
YASNRES

SEQ ID NO: 2681 - protein, 9 aa, Artificial Sequence
  Synthetic polypeptide
QHSWEIPYT

SEQ ID NO: 2682 - protein, 124 aa, Artificial Sequence
  Synthetic polypeptide
QVQLVQSGAEVKKPGASVKVSCKASGYTFTGSWMNWVRQAPGQGLEWMGRIYPGDGDTNYNGKFKGRVTMTADKSTSTAYMELSRLRSDDTAVYYCARDDGYYVAFDYYAMDYWGQGTTVTVSS

SEQ ID NO: 2683 - protein, 111 aa, Artificial Sequence
  Synthetic polypeptide
DIVMTQTPLSLSVSPGQPASISCKSSQSLSRASYSYLHWYLQKPGQPPKLLIKYASNRESGVPDRFSGSGSGTDFTLKISRVEAEDVGVYYCQHSWEIPYTFGQGTKLEIK

SEQ ID NO: 2684 - protein, 250 aa, Artificial Sequence
  Synthetic polypeptide
QVQLVQSGAEVKKPGASVKVSCKASGYTFTGSWMNWVRQAPGQGLEWMGRIYPGDGDTNYNGKFKGRVTMTADKSTSTAYMELSRLRSDDTAVYYCARDDGYYVAFDYYAMDYWGQGTTVTVSSGGGGSGGGGSGGGGSDIVMTQTPLSLSVSPGQPASISCKSSQSLSRASYSYLHWYLQKPGQPPKLLIKYASNRESGVPDRFSGSGSGTDFTLKISRVEAEDVGVYYCQHSWEIPYTFGQGTKLEIK

SEQ ID NO: 2685 - protein, 1102 aa, Artificial Sequence
  Synthetic polypeptide
QVQLVQSGAEVKKPGASVKVSCKASGYTFTGSWMNWVRQAPGQGLEWMGRIYPGDGDTNYNGKFKGRVTMTADKSTSTAYMELSRLRSDDTAVYYCARDDGYYVAFDYYAMDYWGQGTTVTVSSGGGGSGGGGSGGGGSDIVMTQTPLSLSVSPGQPASISCKSSQSLSRASYSYLHWYLQKPGQPPKLLIKYASNRESGVPDRFSGSGSGTDFTLKISRVEAEDVGVYYCQHSWEIPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 2686 - protein, 5 aa, Artificial Sequence
  Synthetic polypeptide
GSWMN

SEQ ID NO: 2687 - protein, 17 aa, Artificial Sequence
  Synthetic polypeptide
RIYPGDGDTNYNGKFKG

SEQ ID NO: 2688 - protein, 15 aa, Artificial Sequence
  Synthetic polypeptide
DDGYYVAFDYYAMDY

SEQ ID NO: 2689 - protein, 15 aa, Artificial Sequence
  Synthetic polypeptide
RSSQSLSRSSYSYLH

SEQ ID NO: 2690 - protein, 7 aa, Artificial Sequence
  Synthetic polypeptide
YASNRES

SEQ ID NO: 2691 - protein, 9 aa, Artificial Sequence
  Synthetic polypeptide
QHSWEIPYT

SEQ ID NO: 2692 - protein, 124 aa, Artificial Sequence; identical to SEQ ID NO: 2682
  Synthetic polypeptide

SEQ ID NO: 2693 - protein, 111 aa, Artificial Sequence
  Synthetic polypeptide
DIVMTQTPLSLSVTPGQPASISCRSSQSLSRSSYSYLHWYLQKPGQPPKLLIKYASNRESGVPDRFSGSGSGTDFTLKISRVEAEDVGVYYCQHSWEIPYTFGQGTKLEIK

SEQ ID NO: 2694 - protein, 250 aa, Artificial Sequence
  Synthetic polypeptide
QVQLVQSGAEVKKPGASVKVSCKASGYTFTGSWMNWVRQAPGQGLEWMGRIYPGDGDTNYNGKFKGRVTMTADKSTSTAYMELSRLRSDDTAVYYCARDDGYYVAFDYYAMDYWGQGTTVTVSSGGGGSGGGGSGGGGSDIVMTQTPLSLSVTPGQPASISCRSSQSLSRSSYSYLHWYLQKPGQPPKLLIKYASNRESGVPDRFSGSGSGTDFTLKISRVEAEDVGVYYCQHSWEIPYTFGQGTKLEIK

SEQ ID NO: 2695 - protein, 1102 aa, Artificial Sequence [sequence omitted]

SEQ ID NO: 2696 - protein, 5 aa, Artificial Sequence
  Synthetic polypeptide
GSWMN

SEQ ID NO: 2697 - protein, 17 aa, Artificial Sequence
  Synthetic polypeptide
RIYPGDGDTNYNGKFKG

SEQ ID NO: 2698 - protein, 15 aa, Artificial Sequence
  Synthetic polypeptide
DDGYYVAFDYYAMDY

SEQ ID NO: 2699 - protein, 15 aa, Artificial Sequence
  Synthetic polypeptide
KSSQSLSRSSYSYLH

SEQ ID NO: 2700 - protein, 7 aa, Artificial Sequence
  Synthetic polypeptide
YASNRES

SEQ ID NO: 2701 - protein, 9 aa, Artificial Sequence
  Synthetic polypeptide
QHSWEIPYT

SEQ ID NO: 2702 - protein, 124 aa, Artificial Sequence
  Synthetic polypeptide
QVQLAQSGAEVKKPGASVKVSCKASGYTFTGSWMNWVRQAPGQGLEWMGRIYPGDGDTNYNGKFKGRVTMTADKSTSTAYMELSRLRSDDTAVYYCARDDGYYVAFDYYAMDYWGQGTTVTVSS

SEQ ID NO: 2703 - protein, 111 aa, Artificial Sequence
  Synthetic polypeptide
DIVMTQTPLSLSVTPGQPASTSCKSSQSLSRSSYSYLHWYLQKPGQPPKLLIKYASNRESGVPDRFSGSGSGTDFTLKISRVEAEDVGVYYCQHSWEIPYTFGQGTKLEIK

SEQ ID NO: 2704 - protein, 250 aa, Artificial Sequence
  Synthetic polypeptide
QVQLAQSGAEVKKPGASVKVSCKASGYTFTGSWMNWVRQAPGQGLEWMGRIYPGDGDTNYNGKFKGRVTMTADKSTSTAYMELSRLRSDDTAVYYCARDDGYYVAFDYYAMDYWGQGTTVTVSSGGGGSGGGGSGGGGSDIVMTQTPLSLSVTPGQPASTSCKSSQSLSRSSYSYLHWYLQKPGQPPKLLIKYASNRESGVPDRFSGSGSGTDFTLKISRVEAEDVGVYYCQHSWEIPYTFGQGTKLEIK

SEQ ID NO: 2705 - protein, 1102 aa, Artificial Sequence
  Synthetic polypeptide
QVQLAQSGAEVKKPGASVKVSCKASGYTFTGSWMNWVRQAPGQGLEWMGRIYPGDGDTNYNGKFKGRVTMTADKSTSTAYMELSRLRSDDTAVYYCARDDGYYVAFDYYAMDYWGQGTTVTVSSGGGGSGGGGSGGGGSDIVMTQTPLSLSVTPGQPASTSCKSSQSLSRSSYSYLHWYLQKPGQPPKLLIKYASNRESGVPDRFSGSGSGTDFTLKISRVEAEDVGVYYCQHSWEIPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 2706 - protein, 249 aa, Artificial Sequence
  Synthetic polypeptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 2707 - protein, 6 aa, Artificial Sequence
  Synthetic polypeptide
PGGGGS

SEQ ID NO: 2708 - protein, 6 aa, Artificial Sequence
  Synthetic polypeptide
PGGDGS

SEQ ID NO: 2709 - protein, 6 aa, Artificial Sequence
  Synthetic polypeptide
SGGGGS

The invention claimed is:

1. A bispecific single chain antibody construct comprising a first binding domain which binds a viral antigen on the surface of an infected host cell and a second binding domain which binds to a T cell surface antigen CD3, wherein the second binding domain comprises a VL region having CDR-L1-L3 and a VH region having CDR-H1-H3 selected from the group consisting of:
   (a) CDR-L1-L3 as depicted in SEQ ID NOs: 14-16 and CDR-H1-H3 as depicted in SEQ ID NOs: 17-19;
   (b) CDR-L1-L3 as depicted in SEQ ID NOs: 26-28 and CDR-H1-H3 as depicted in SEQ ID NOs: 29-31;
   (c) CDR-L1-L3 as depicted in SEQ ID NOs: 38-40 and CDR-H1-H3 as depicted in SEQ ID NOs: 41-43;
   (d) CDR-L1-L3 as depicted in SEQ ID NOs: 50-52 and CDR-H1-H3 as depicted in SEQ ID NOs: 53-55;
   (e) CDR-L1-L3 as depicted in SEQ ID NOs: 62-64 and CDR-H1-H3 as depicted in SEQ ID NOs: 65-67;
   (f) CDR-L1-L3 as depicted in SEQ ID NOs: 74-76 and CDR-H1-H3 as depicted in SEQ ID NOs: 77-79;
   (g) CDR-L1-L3 as depicted in SEQ ID NOs: 86-88 and CDR-H1-H3 as depicted in SEQ ID NOs: 89-91;
   (h) CDR-L1-L3 as depicted in SEQ ID NOs: 98-100 and CDR-H1-H3 as depicted in SEQ ID NOs: 101-103;
   (i) CDR-L1-L3 as depicted in SEQ ID NOs: 110-112 and CDR-H1-H3 as depicted in SEQ ID NOs: 113-115; and
   (j) CDR-L1-L3 as depicted in SEQ ID NOs: 122-124 and CDR-H1-H3 as depicted in SEQ ID NOs: 125-127;
and
wherein a serum albumin is fused to the C-terminus of the construct to sterically impair dimerization or multimerization of the antibody construct via the second binding domain to prevent activation of T cells in the absence of target cells up to a concentration of 2 mg/ml of the bispecific single chain antibody construct.

2. The antibody construct according to claim 1, wherein the serum albumin is a human serum albumin or an FcRn binding optimized variant thereof.

3. The antibody construct according to claim 1, wherein the serum albumin comprises an amino acid sequence selected from the group consisting of SEQ ID NOs: 4 to 12 and 608 to 628.

4. The antibody construct according to claim 1, wherein the serum albumin is linked to the antibody construct via a peptide linker.

5. The antibody construct according to claim 4, wherein the peptide linker has the amino acid sequence $(GGGGS)_n$ (SEQ ID NO: 13)$_n$ wherein n is an integer in the range of 1 to 5.

6. The antibody construct according to claim 1, wherein the second binding domain comprises pairs of VH and VL chains selected from the group consisting of:
   (a) a VH-chain comprising the amino acid sequence set forth in SEQ ID NO: 20 and a VL-chain comprising the amino acid sequence set forth in-SEQ ID NO: 22;
   (b) a VH-chain comprising the amino acid sequence set forth in SEQ ID NO: 32 and a VL-chain comprising the amino acid sequence set forth in SEQ ID NO: 34;
   (c) a VH-chain comprising the amino acid sequence set forth in SEQ ID NO: 44 and a VL-chain comprising the amino acid sequence set forth in SEQ ID NO: 46;
   (d) a VH-chain comprising the amino acid sequence set forth in SEQ ID NO: 56 and a VL-chain comprising the amino acid sequence set forth in SEQ ID NO: 58;
   (e) a VH-chain comprising the amino acid sequence set forth in SEQ ID NO: 68 and a VL-chain comprising the amino acid sequence set forth in SEQ ID NO: 70;
   (f) a VH-chain comprising the amino acid sequence set forth in SEQ ID NO: 80 and a VL-chain comprising the amino acid sequence set forth in SEQ ID NO: 82;
   (g) a VH-chain comprising the amino acid sequence set forth in SEQ ID NO: 92 and a VL-chain comprising the amino acid sequence set forth in SEQ ID NO: 94;
   (h) a VH-chain comprising the amino acid sequence set forth in SEQ ID NO: 104 and a VL-chain comprising the amino acid sequence set forth in SEQ ID NO: 106;
   (i) a VH-chain comprising the amino acid sequence set forth in SEQ ID NO: 116 and a VL-chain comprising the amino acid sequence set forth in SEQ ID NO: 118; and
   (j) a VH-chain comprising the amino acid sequence set forth in SEQ ID NO: 128 and a VL-chain comprising the amino acid sequence set forth in SEQ ID NO: 130.

7. The antibody construct according to claim 1, wherein the second binding domain comprises the amino acid sequence set forth in SEQ ID NO: 24, SEQ ID NO: 36, SEQ ID NO: 48, SEQ ID NO: 60, SEQ ID NO: 72, SEQ ID NO: 84, SEQ ID NO: 96, SEQ ID NO: 108, SEQ ID NO: 120 or SEQ ID NO: 132.

8. The antibody construct according to claim 1, wherein the antibody construct comprises the following elements starting from the N-terminus:
(a) an scFv binding to the viral antigen comprising the amino acid sequence selected from the group consisting of SEQ ID NOs: 2654, 2664, 2674, 2684, 2694, and 2704;
(b) a peptide linker comprising the amino acid sequence selected from the group consisting of: SEQ ID NOs: 13 and 2707-2709;
(c) an scFv binding to the T cell surface antigen CD3 comprising the amino acid sequence selected from the group consisting of SEQ ID NOs: 24, 36, 48, 60, 72, 84, 96, 108,120,132 and 2706;
(d) a peptide linker comprising the amino acid sequence selected from the group consisting of SEQ ID NOs: 13 and 2707-2709;
(e) a serum albumin comprising the amino acid sequence selected from the group consisting of SEQ ID NOs: 4 to 12 and 608 to 628; and
(f) optionally a His-tag.

9. A pharmaceutical composition comprising the antibody construct according to claim 1.

10. A kit comprising the antibody construct according to claim 1 and a recipient and, optionally, directions for use.

11. The antibody construct according to claim 1, wherein the serum albumin is fused to prevent activation of T cells in the absence of target cells at a concentration up to 1 mg/ml of the bispecific single chain antibody construct.

12. The antibody construct according to claim 1, wherein the serum albumin is fused to prevent activation of T cells in the absence of target cells at a concentration up to 500 ng/ml of the bispecific single chain antibody construct.

* * * * *

UNITED STATES PATENT AND TRADEMARK OFFICE
CERTIFICATE OF CORRECTION

PATENT NO. : 11,661,462 B2
APPLICATION NO. : 15/329672
DATED : May 30, 2023
INVENTOR(S) : Benno Rattel et al.

It is certified that error appears in the above-identified patent and that said Letters Patent is hereby corrected as shown below:

On the Title Page

At item (54), Line 3, and in the Specification, Column 1, Line 3, "CONTRUCTS" should be -- CONSTRUCTS --.

In the Claims

At Column 54, Line 33, "in-SEQ" should be -- in SEQ --.

Signed and Sealed this
Thirtieth Day of January, 2024

Katherine Kelly Vidal
*Director of the United States Patent and Trademark Office*